US011266724B2

(12) United States Patent
Blouse et al.

(10) Patent No.: US 11,266,724 B2
(45) Date of Patent: *Mar. 8, 2022

(54) MODIFIED FACTOR VII POLYPEPTIDES FOR SUBCUTANEOUS ADMINISTRATION AND ON-DEMAND TREATMENT

(71) Applicant: Catalyst Biosciences, Inc., South San Francisco, CA (US)

(72) Inventors: Grant E. Blouse, Burlingame, CA (US); Tom Knudsen, Burlingame, CA (US); Howard Levy, Hopewell, NJ (US)

(73) Assignee: CATALYST BIOSCIENCES, INC., South San Francisco, CA (US)

( * ) Notice: Subject to any disclaimer, the term of this patent is extended or adjusted under 35 U.S.C. 154(b) by 0 days.

This patent is subject to a terminal disclaimer.

(21) Appl. No.: 17/180,666

(22) Filed: Feb. 19, 2021

(65) Prior Publication Data

US 2021/0187083 A1    Jun. 24, 2021

Related U.S. Application Data

(63) Continuation of application No. 16/994,573, filed on Aug. 15, 2020.

(60) Provisional application No. 63/010,656, filed on Apr. 15, 2020, provisional application No. 62/970,152, filed on Feb. 4, 2020, provisional application No. 62/887,599, filed on Aug. 15, 2019.

(51) Int. Cl.
| | | |
|---|---|---|
| *C07K 14/745* | (2006.01) | |
| *A61K 38/48* | (2006.01) | |
| *A61P 7/04* | (2006.01) | |
| *A61K 9/00* | (2006.01) | |
| *A61K 31/7105* | (2006.01) | |
| *A61K 39/395* | (2006.01) | |
| *C07K 16/36* | (2006.01) | |
| *C12N 15/113* | (2010.01) | |
| *A61K 39/00* | (2006.01) | |

(52) U.S. Cl.
CPC ........ *A61K 38/4846* (2013.01); *A61K 9/0019* (2013.01); *A61K 31/7105* (2013.01); *A61K 39/3955* (2013.01); *A61P 7/04* (2018.01); *C07K 16/36* (2013.01); *C12N 15/113* (2013.01); *C12Y 304/21021* (2013.01); *A61K 2039/505* (2013.01); *C07K 2317/24* (2013.01); *C07K 2317/31* (2013.01); *C12N 2310/14* (2013.01); *C12N 2320/31* (2013.01)

(58) Field of Classification Search
None
See application file for complete search history.

(56) References Cited

U.S. PATENT DOCUMENTS

| | | | |
|---|---|---|---|
| 4,522,811 A | 6/1985 | Eppstein et al. | |
| 4,784,950 A | 11/1988 | Hagen et al. | |
| 4,892,538 A | 1/1990 | Aebischer et al. | |
| 4,952,496 A | 8/1990 | Studier et al. | |
| 5,033,252 A | 7/1991 | Carter | |
| 5,052,558 A | 10/1991 | Carter | |
| 5,283,187 A | 2/1994 | Aebischer et al. | |
| 5,323,907 A | 6/1994 | Kalvelage | |
| 5,580,560 A | 12/1996 | Nicolaisen et al. | |
| 5,788,965 A | 8/1998 | Berkner et al. | |
| 5,817,788 A | 10/1998 | Berkner et al. | |
| 5,824,639 A | 10/1998 | Berkner | |
| 5,837,679 A | 11/1998 | Wolf et al. | |
| 5,861,374 A | 1/1999 | Berkner et al. | |
| 6,017,882 A | 1/2000 | Nelsestuen | |
| 6,183,743 B1 | 2/2001 | Hart et al. | |
| 6,677,440 B1 | 1/2004 | Roemisch et al. | |
| 6,693,075 B1 | 2/2004 | Nelsestuen | |
| 6,762,286 B2 | 7/2004 | Nelsestuen | |
| 6,806,063 B2 | 10/2004 | Pedersen et al. | |
| 6,903,069 B2 | 6/2005 | Pingel et al. | |
| 6,905,683 B2 | 6/2005 | Persson et al. | |
| 6,911,323 B2 | 6/2005 | Persson et al. | |
| 6,960,657 B2 | 11/2005 | Persson et al. | |
| 7,026,524 B2 | 4/2006 | Persson et al. | |
| 7,052,868 B2 | 5/2006 | Persson et al. | |
| 7,173,000 B2 | 2/2007 | Ruf et al. | |
| 7,176,288 B2 | 2/2007 | Persson et al. | |
| 7,220,837 B1 | 5/2007 | Nelsestuen | |
| 7,235,638 B2 | 6/2007 | Persson | |
| 7,247,708 B2 | 7/2007 | Nelsestuen | |
| 7,291,587 B2 | 11/2007 | Rojkjaer | |

(Continued)

FOREIGN PATENT DOCUMENTS

| | | |
|---|---|---|
| EP | 1 361 284 A1 | 11/2003 |
| EP | 1 726 643 A1 | 11/2006 |
| EP | 1 504 117 B1 | 7/2007 |
| EP | 2 316 930 A1 | 5/2011 |
| EP | 1 633 865 B1 | 9/2011 |

(Continued)

OTHER PUBLICATIONS

Gruppo RA, et al., Phase 1, single-dose escalating study of marzeptacog alfa (activated), a recombinant factor VIIa variant, in patients with severe hemophilia. J Thromb Haemost 2018; 16: 1984-93.*

(Continued)

*Primary Examiner* — Michael Szperka
(74) *Attorney, Agent, or Firm* — Cooley LLP

(57) ABSTRACT

Provided herein are modified FVII polypetides, and modified FVIIa polypeptides, and methods of treatment of acute and episodic bleeding with modified FactorVIIa polypeptides. To effect treatment and use, in some embodiments, the modified polypeptides are subcutaneously administered to provide on-demand treatment. In some embodiments, the on-demand treatment is provided in a multiple dosing regimen over a twenty-four hour period. The subcutaneous administration of the modified polypeptides of the disclosure exhibit increased coagulant activity, potency, bioavailablilty and prolonged duration.

17 Claims, 88 Drawing Sheets

Specification includes a Sequence Listing.

(56) References Cited

U.S. PATENT DOCUMENTS

| | | |
|---|---|---|
| 7,416,861 B2 | 8/2008 | Persson et al. |
| 7,419,949 B2 | 9/2008 | Hedner |
| 7,427,592 B2 | 9/2008 | Pedersen et al. |
| 7,432,352 B2 | 10/2008 | Johansen |
| 7,442,524 B2 | 10/2008 | Pedersen et al. |
| 7,511,024 B2 | 3/2009 | Pedersen et al. |
| 7,521,210 B2 | 4/2009 | Knudsen |
| 7,897,734 B2 | 3/2011 | Krarup |
| 8,211,428 B2 | 7/2012 | Madison |
| 8,299,029 B2 | 10/2012 | Jensen et al. |
| 8,519,103 B2 * | 8/2013 | Madison ............... C12N 15/62 530/384 |
| 8,663,633 B2 | 3/2014 | Madison et al. |
| 8,778,870 B2 | 7/2014 | Madison et al. |
| 9,102,762 B2 | 8/2015 | Christensen et al. |
| 9,102,962 B2 | 8/2015 | Chen |
| 9,358,275 B2 | 6/2016 | Bardat et al. |
| 9,476,037 B2 | 10/2016 | Madison et al. |
| 10,160,961 B2 | 12/2018 | Madison et al. |
| 10,717,970 B2 | 7/2020 | Bauzon et al. |
| 2002/0166130 A1 | 11/2002 | Velander et al. |
| 2003/0044908 A1 | 3/2003 | Persson |
| 2003/0069395 A1 | 4/2003 | Sato et al. |
| 2003/0096338 A1 | 5/2003 | Pedersen et al. |
| 2003/0100075 A1 | 5/2003 | Persson et al. |
| 2003/0100506 A1 | 5/2003 | Nelsestuen |
| 2003/0100740 A1 | 5/2003 | Persson et al. |
| 2003/0104978 A1 | 6/2003 | Persson et al. |
| 2003/0119168 A1 | 6/2003 | Madison et al. |
| 2003/0130191 A1 | 7/2003 | Persson et al. |
| 2003/0134298 A1 | 7/2003 | Madison et al. |
| 2003/0134794 A1 | 7/2003 | Madison et al. |
| 2003/0143219 A1 | 7/2003 | Madison et al. |
| 2003/0211094 A1 | 11/2003 | Nelsestuen |
| 2004/0001801 A1 | 1/2004 | Madison et al. |
| 2004/0009534 A1 | 1/2004 | Sato et al. |
| 2004/0087498 A1 | 5/2004 | Berkner et al. |
| 2004/0133930 A1 | 7/2004 | Cooper et al. |
| 2004/0146938 A1 | 7/2004 | Nguyen et al. |
| 2004/0192602 A1 | 9/2004 | Persson et al. |
| 2004/0220106 A1 | 11/2004 | Nelsestuen |
| 2005/0032690 A1 | 2/2005 | Rojkjaer et al. |
| 2005/0112579 A1 | 5/2005 | Madison et al. |
| 2005/0113565 A1 | 5/2005 | Klausen et al. |
| 2005/0164932 A1 | 7/2005 | Haaning et al. |
| 2005/0204406 A1 | 9/2005 | Persson et al. |
| 2005/0204411 A1 | 9/2005 | Persson et al. |
| 2006/0002916 A1 | 1/2006 | Nguyen et al. |
| 2006/0019336 A1 | 1/2006 | Pederson et al. |
| 2006/0019893 A1 | 1/2006 | Maun et al. |
| 2006/0019894 A1 | 1/2006 | Brun et al. |
| 2006/0024289 A1 | 2/2006 | Ruggles et al. |
| 2006/0029590 A1 | 2/2006 | Pianos et al. |
| 2006/0111282 A1 | 5/2006 | Haaning et al. |
| 2006/0116324 A1 | 6/2006 | Persson et al. |
| 2006/0166874 A1 | 7/2006 | Haaning et al. |
| 2006/0166915 A1 | 7/2006 | Persson et al. |
| 2006/0194289 A1 | 8/2006 | Knudsen |
| 2006/0205036 A1 | 9/2006 | Ostergaard et al. |
| 2006/0228782 A1 | 10/2006 | Pedersen et al. |
| 2006/0240524 A1 | 10/2006 | Pedersen et al. |
| 2006/0240525 A1 | 10/2006 | Pedersen et al. |
| 2006/0240526 A1 | 10/2006 | Hanning et al. |
| 2006/0241041 A1 | 10/2006 | Haaning et al. |
| 2006/0252127 A1 | 11/2006 | Pedersen et al. |
| 2006/0252128 A1 | 11/2006 | Haaning et al. |
| 2006/0252129 A1 | 11/2006 | Persson et al. |
| 2006/0252689 A1 | 11/2006 | Pedersen et al. |
| 2006/0252690 A1 | 11/2006 | Pedersen et al. |
| 2006/0258585 A1 | 11/2006 | Pedersen et al. |
| 2006/0258851 A1 | 11/2006 | Johansen |
| 2006/0264373 A1 | 11/2006 | Nelsestuen |
| 2006/0270000 A1 | 11/2006 | Haaning et al. |
| 2006/0270001 A1 | 11/2006 | Haaning et al. |
| 2006/0270002 A1 | 11/2006 | Haaning et al. |
| 2006/0276377 A1 | 12/2006 | Haaning et al. |
| 2007/0037746 A1 | 2/2007 | Ostergaard et al. |
| 2007/0054366 A1 | 3/2007 | Andersen et al. |
| 2007/0093443 A1 | 4/2007 | Madison et al. |
| 2007/0117756 A1 | 5/2007 | Haaning et al. |
| 2007/0142280 A1 | 6/2007 | Pedersen et al. |
| 2007/0202045 A1 | 8/2007 | Dennis |
| 2007/0243588 A1 | 10/2007 | Pedersen et al. |
| 2007/0280920 A1 | 12/2007 | Petersen et al. |
| 2008/0004216 A1 | 1/2008 | Nelsestuen |
| 2008/0010693 A1 | 1/2008 | Persson et al. |
| 2008/0026994 A1 | 1/2008 | Nelsestuen |
| 2008/0058255 A1 | 3/2008 | Bolt et al. |
| 2008/0102115 A1 | 5/2008 | Oyhenart et al. |
| 2008/0188400 A1 | 8/2008 | Ropke et al. |
| 2009/0047210 A1 | 2/2009 | Ruggles et al. |
| 2009/0055942 A1 | 2/2009 | Ostergaard et al. |
| 2009/0098103 A1 | 4/2009 | Madison et al. |
| 2009/0123452 A1 | 5/2009 | Madison |
| 2009/0136477 A1 | 5/2009 | Nguyen et al. |
| 2009/0291890 A1 | 11/2009 | Madison |
| 2010/0166729 A9 | 7/2010 | Madison et al. |
| 2010/0330059 A1 | 12/2010 | Stafford et al. |
| 2012/0242062 A1 | 9/2012 | Schroeder et al. |
| 2012/0244139 A1 | 9/2012 | Madison et al. |
| 2012/0301945 A1 | 11/2012 | Madison et al. |
| 2012/0308540 A1 | 12/2012 | Madison et al. |
| 2012/0308551 A1 | 12/2012 | Madison |
| 2013/0164820 A9 | 6/2013 | Madison |
| 2013/0177541 A9 | 7/2013 | Madison et al. |
| 2014/0030247 A1 | 1/2014 | Madison et al. |
| 2014/0030791 A1 | 1/2014 | Madison et al. |
| 2014/0044701 A1 | 2/2014 | Madison et al. |
| 2014/0234290 A1 | 8/2014 | Madison et al. |
| 2014/0322191 A1 | 10/2014 | Madison |
| 2019/0055534 A1 | 2/2019 | Madison |
| 2021/0069306 A1 | 3/2021 | Blouse et al. |

FOREIGN PATENT DOCUMENTS

| | | | |
|---|---|---|---|
| EP | 2 226 385 B1 | 7/2013 | |
| EP | 1 745 141 B2 | 9/2019 | |
| IN | 206981 A1 | 6/2007 | |
| WO | WO-88/10295 A1 | 12/1988 | |
| WO | WO-92/06203 A1 | 4/1992 | |
| WO | WO-0102439 A1 * | 1/2001 | ......... C07K 16/3053 |
| WO | WO-01/32711 A2 | 5/2001 | |
| WO | WO-01/32711 A3 | 5/2001 | |
| WO | WO-01/58935 A2 | 8/2001 | |
| WO | WO-01/58935 A3 | 8/2001 | |
| WO | WO-01/82943 A2 | 11/2001 | |
| WO | WO-01/82943 A3 | 11/2001 | |
| WO | WO-01/83725 A1 | 11/2001 | |
| WO | WO-01/85199 A1 | 11/2001 | |
| WO | WO-02/20475 A2 | 3/2002 | |
| WO | WO-02/20475 A3 | 3/2002 | |
| WO | WO-02/22776 A2 | 3/2002 | |
| WO | WO-02/22776 A3 | 3/2002 | |
| WO | WO-02/38162 A1 | 5/2002 | |
| WO | WO-02/062377 A2 | 8/2002 | |
| WO | WO-02/062377 A3 | 8/2002 | |
| WO | WO-02/072786 A2 | 9/2002 | |
| WO | WO-02/072786 A3 | 9/2002 | |
| WO | WO-02/077218 A1 | 10/2002 | |
| WO | WO-02/077263 A2 | 10/2002 | |
| WO | WO-02/077263 A3 | 10/2002 | |
| WO | WO-02/077267 A2 | 10/2002 | |
| WO | WO-02/077267 A3 | 10/2002 | |
| WO | WO-02/092841 A2 | 11/2002 | |
| WO | WO-02/092841 A3 | 11/2002 | |
| WO | WO-02/095007 A2 | 11/2002 | |
| WO | WO-02/095007 A3 | 11/2002 | |
| WO | WO-03/004681 A2 | 1/2003 | |
| WO | WO-03/004681 A3 | 1/2003 | |
| WO | WO-03/027147 A2 | 4/2003 | |
| WO | WO-03/027147 A3 | 4/2003 | |
| WO | WO-03/029442 A1 | 4/2003 | |
| WO | WO-03/031585 A2 | 4/2003 | |
| WO | WO-03/031585 A3 | 4/2003 | |

(56) References Cited

FOREIGN PATENT DOCUMENTS

| | | |
|---|---|---|
| WO | WO-03/044179 A2 | 5/2003 |
| WO | WO-03/044179 A3 | 5/2003 |
| WO | WO-03/037932 A2 | 7/2003 |
| WO | WO-03/037932 A3 | 7/2003 |
| WO | WO-03/055511 A1 | 7/2003 |
| WO | WO-03/055512 A1 | 7/2003 |
| WO | WO-03/093465 A1 | 11/2003 |
| WO | WO-03/095670 A2 | 11/2003 |
| WO | WO-03/095670 A3 | 11/2003 |
| WO | WO-03/104394 A2 | 12/2003 |
| WO | WO-03/104394 A3 | 12/2003 |
| WO | WO-2004/000366 A1 | 12/2003 |
| WO | WO-2004/005471 A2 | 1/2004 |
| WO | WO-2004/005471 A3 | 1/2004 |
| WO | WO-2004/029090 A1 | 4/2004 |
| WO | WO-2004/029091 A2 | 4/2004 |
| WO | WO-2004/029091 A3 | 4/2004 |
| WO | WO-2004/031733 A2 | 4/2004 |
| WO | WO-2004/031733 A3 | 4/2004 |
| WO | WO-2004/056384 A2 | 7/2004 |
| WO | WO-2004/056384 A3 | 7/2004 |
| WO | WO-2004/083361 A2 | 9/2004 |
| WO | WO-2004/083361 A3 | 9/2004 |
| WO | WO-2004/083421 A1 | 9/2004 |
| WO | WO-2004/108763 A2 | 12/2004 |
| WO | WO-2004/108763 A3 | 12/2004 |
| WO | WO-2004/110469 A2 | 12/2004 |
| WO | WO-2004/110469 A3 | 12/2004 |
| WO | WO-2004/111242 A1 | 12/2004 |
| WO | WO-2004/113521 A1 | 12/2004 |
| WO | WO-2004/113522 A1 | 12/2004 |
| WO | WO-2005/023308 A1 | 3/2005 |
| WO | WO-2005/024006 A2 | 3/2005 |
| WO | WO-2005/024006 A3 | 3/2005 |
| WO | WO-2005/032581 A2 | 4/2005 |
| WO | WO-2005/032581 A3 | 4/2005 |
| WO | WO-2005/051289 A2 | 6/2005 |
| WO | WO-2005/051289 A3 | 6/2005 |
| WO | WO-2005/068620 A1 | 7/2005 |
| WO | WO-2005/075635 A2 | 8/2005 |
| WO | WO-2005/075635 A3 | 8/2005 |
| WO | WO-2005/100556 A2 | 10/2005 |
| WO | WO-2005/100556 A3 | 10/2005 |
| WO | WO-2005/110453 A2 | 11/2005 |
| WO | WO-2005/110453 A3 | 11/2005 |
| WO | WO-2005/111225 A1 | 11/2005 |
| WO | WO-2005/123119 A2 | 12/2005 |
| WO | WO-2005/123119 A3 | 12/2005 |
| WO | WO-2005/123916 A2 | 12/2005 |
| WO | WO-2005/123916 A3 | 12/2005 |
| WO | WO-2006/008267 A2 | 1/2006 |
| WO | WO-2006/008267 A3 | 1/2006 |
| WO | WO-2006/013202 A2 | 2/2006 |
| WO | WO-2006/013202 A3 | 2/2006 |
| WO | WO-2006/014253 A2 | 2/2006 |
| WO | WO-2006/014253 A3 | 2/2006 |
| WO | WO-2006/018204 A1 | 2/2006 |
| WO | WO-2006/035057 A1 | 4/2006 |
| WO | WO-2006/067198 A2 | 6/2006 |
| WO | WO-2006/067198 A3 | 6/2006 |
| WO | WO-2006/067230 A1 | 6/2006 |
| WO | WO-2006/114105 A2 | 11/2006 |
| WO | WO-2006/114105 A3 | 11/2006 |
| WO | WO-2006/114448 A2 | 11/2006 |
| WO | WO-2006/114448 A3 | 11/2006 |
| WO | WO-2006/125827 A1 | 11/2006 |
| WO | WO-2006/134173 A2 | 12/2006 |
| WO | WO-2006/134173 A3 | 12/2006 |
| WO | WO-2006/134174 A2 | 12/2006 |
| WO | WO-2006/134174 A3 | 12/2006 |
| WO | WO-2007/022512 A2 | 2/2007 |
| WO | WO-2007/022512 A3 | 2/2007 |
| WO | WO-2007/022784 A2 | 3/2007 |
| WO | WO-2007/022784 A3 | 3/2007 |
| WO | WO-2007/026020 A1 | 3/2007 |
| WO | WO-2007/031559 A2 | 3/2007 |
| WO | WO-2007/031559 A3 | 3/2007 |
| WO | WO-2007/039475 A1 | 4/2007 |
| WO | WO-2007/044874 A2 | 4/2007 |
| WO | WO-2007/044874 A3 | 4/2007 |
| WO | WO-2007/047995 A2 | 4/2007 |
| WO | WO-2007/047995 A3 | 4/2007 |
| WO | WO-2007/149406 A2 | 12/2007 |
| WO | WO-2007/149406 A3 | 12/2007 |
| WO | WO-2008/009634 A2 | 1/2008 |
| WO | WO-2008/009634 A3 | 1/2008 |
| WO | WO-2008/009635 A2 | 1/2008 |
| WO | WO-2008/009635 A3 | 1/2008 |
| WO | WO-2008/045148 A2 | 4/2008 |
| WO | WO-2008/045148 A3 | 4/2008 |
| WO | WO-2008/078189 A2 | 7/2008 |
| WO | WO-2008/078189 A3 | 7/2008 |
| WO | WO-2008/090215 A1 | 7/2008 |
| WO | WO-2008/127702 A2 | 10/2008 |
| WO | WO-2008/127702 A3 | 10/2008 |
| WO | WO-2009/126307 A2 | 10/2009 |
| WO | WO-2009/126307 A3 | 10/2009 |
| WO | WO-2009126307 A2 * | 10/2009 ............. C12N 15/62 |
| WO | WO-2014/060401 A1 | 4/2014 |

OTHER PUBLICATIONS

NCT03407651, Phase 2 Study of Coagulation Factor VIIa Variant Marzeptacog Alfa (Activated) in Adult Subjects With Hemophilia A and B, Submitted: Jan. 16, 2018 (v1), downloaded from clinicaltrials.gov/ on Apr. 13, 2021, 4 pages.*

Adams et al., "The c-myc oncogene driven by immunoglobulin enhancers induces lymphoid malignancy in transgenic mice," Nature 318:533-538 (1985).

Al Douri et al., "Effect of the administration of recombinant activated factor VII (rFVIIa; NovoSeven) in the management of severe uncontrolled bleeding in patients undergoing heart valve replacement surgery," Blood CoaG Fibrinol 11:S121-S127 (2000).

Al-Tamimi et al. "Coagulation-induced shedding of platelet glycoprotein VI mediated by factor Xa," Blood 117: 3912-3920 (2011).

Alexander et al., "Expression of the c-myc oncogene under control of an immunoglobulin enhancer in E mu-myc transgenic mice," Mol. Cell Biol. 7:1436-1444 (1987).

Allen et al. "A variant of recombinant factor VIIa with enhanced procoagulant and antifibrinolytic activities in an in vitro model of hemophilia," Arteriosclerosis Thrombosis and Vascular Biology.

Altschul et al., "Basic local alignment search tool," J. Molec. Biol. 215:403 (1990).

Arbini et al., "A Thr$^{359}$Met mutation in factor VII of a patient with a hereditary deficiency causes defective secretion of the molecule," Blood 87(12):5085-5094 (1996).

Bajaj et al., "High resolution structures of p-aminobenzamidine- and benzamidine-VIIa/soluble tissue factor: unpredicted conformation of the 192-193 peptide bond and mapping of Ca2+, Mg2+, Na+, and Zn2+ sites in factor VIIa," J. Biol. Chem. 281:24873-24888 (2006).

Banner et al., "The crystal structure of the complex of blood coagulation factor VIIa with soluble tissue factor," Nature 380:41-46 (1996).

Baugh et al. (1998). "Regulation of extrinsic pathway Xa formation by tissue factor pathway inhibitor," J. Biol. Chem. 20:4378-4386.

Becker et al., "Endothelial function and hemostasis," Z. Kardiologie 89:160-167 (2000).

Benoist, C. and P. Chambon, "In vivo sequence requirements of the SV40 early promoter region," Nature 290:304-310 (1981).

Bernardi et al., "Molecular defects in CRM+ factor VII deficiencies: modelling of missense mutations in the catalytic domain of FVII," Br. J. Haematol. 86:610-618 (1994).

Bernardi et al., "Mutation pattern in clinically asymptomatic coagulation factor VII deficiency," Human Mut. 8:108-115 (1996).

Bharadwaj et al., "Factor VII central: a novel mutation in the catalytic domain that reduces tissue factor binding, impairs activation by factor Xa, and abolishes amidolytic and coagulant activity," J. Biol Chem. 271(48):30685-30691 (1996).

(56) References Cited

OTHER PUBLICATIONS

Bi et al., "Targeted disruption of the mouse factor VIII gene produces a model of haemophilia A," Nat Gen 10:119-121 (1995).
BioWorld Today, "Other news to note," BioWorld Today 21(243):2 (2010).
Bjelke et al., "A loop of coagulation factor VIIa influencing macromolecular substrate specificity," FEBS Lett. 581(1):71-76 (2007).
Bjelke et al., "Mechanism of the Ca2+-induced enhancement of the intrinsic factor VIIa activity," J Biol Chem. 283(38):25863-25870 (2008).
Bjoern et al., "Human plasma and recombinant Factor VII," J Biol Chem. 2166:11051-11057 (1991).
Bock et al., "Isolation of human blood coagulation alpha-factor Xa by soybean trypsin inhibitor-sepharose chromatography and its active-site titration with fluorescein mono-p-guanidinobenzoate," Archives of Biochemistry and Biophysics 273:375-388 (1989).
Boggio et al., "Recombinant human factor VIIa in the management of amyloid-associated factor X deficiency," Br J Haematol 112:1074-1075 (2001).
Bowie et al., "Deciphering the message in protein sequences: tolerance to amino acid substitutions," Science 247:1306-1310 (1990).
Brinkhous et al., "Effect of recombinant factor VIIa on the hemostatic defect in dogs with hemophilia A, hemophilia B, and von Willebrand disease," PNAS 86:1382-1386 (1989).
Brinster et al., "Regulation of metallothionein-thymidine kinase fusion plasmids injected into mouse eggs," Nature 296:39-42 (1982).
Brophy et al., "Effect of recombinant factor VIIa variant (NN1731) on platelet function, clot structure and force onset time in whole blood from healthy volunteers and haemophilia patients," Haemophilia 13(5):533-541 (2007).
Broze et al., "Purification and properties of human coagulation factor VII," J Biol Chem 255:1242-1247 (1980).
Butenas et al., "Kinetics of human factor VII activation," Biochemistry 35:1904-1910 (1996).
Callaghan, M. et al. (2019). "Emicizumab treatment is efficacious and well tolerated long term in persons with Haemophilia A (PwHA) with or without FVIII inhibitors: Pooled data from four HAVEN studies," Rpth, OC 60.2, p. 116.
Carrillo et al., "The multiple sequence alignment problem in biology," SIAM J Applied Math 48: 1073 (1988).
Catalyst Biosciences Press Release, "Factor VII program for hemophilia," Published on May 6, 2008 [online]; Retrieved from: <URL: catalystbiosciences.com/news-pr-factor VII.html (2 pages).
Catalyst Biosciences Press Release, "Catalyst Biosciences and CMC Biologies Announce Manufacturing Agreement for Catalyst's Next-Generation Factor VIIa Product CB 813d." Published on May 24, 2016 [online]; 2 pages.
Catalyst Biosciences: The Protease Therapeutics Company, Presentation, "Company Overview Jun. 2014," published Jun. 2, 2014 [online]; retrieved on Nov. 29, 2016 from: <URL:ir.catalystbiosciences. com/phoenix.zhtml?c=254141&p=irol-newsArticle&ID=2192374, 19 pages.
Catalyst Biosciences: Company Overview, Presentation, May 2016 [online]; Retrieved on Jan. 17, 2016, from: <URL:ir.catalystbiosciences. com/phoenix.zhtml?c=254141&p=irol-calendar, 25 pages.
Catalyst Biosciences Press Release, "Catalyst Biosciences Receives Patents Covering its Hemostasis and Anti-Complement Programs," Published on Jun. 20, 2016 [online]; 2 pages.
Catalyst Biosciences Company Update, "Catalyst Biosciences Provides Corporate Update and Reports Second Quarter 2016 Earnings," Published by Lifesci Capital Equity Research on Aug. 4, 2016, 3 pages.
Catalyst Biosciences Press Release, "Catalyst Biosciences Reports Second Quarter 2017 Financial Results and Provides Subcutaneous (SQ) Hemophilia Program Update," published Aug. 3, 2017 [online]; retrieved on Jan. 30, 2018 from; <URL:ir.catalystbiosciences.com/ phoenix.zhtml ?c=254 1 4 1&p=irol-newsArticle_print&ID= 2291512, 4 pages.
Catalyst Biosciences Presentation, "Essential Medicines for Hemophilia. Greater Convenience. Superior Outcomes," at the Ladenburg Thalmann Healthcare Conference, Sep. 27, 2016, New York City, New York, 20 pages.
Catalyst Biosciences Press Release, "Catalyst Biosciences to Focus Resources on Clinical Hemostasis Programs," Published on Sep. 7, 2016 [online]; Retrieved on Jan. 17, 2017, from: <URL:ir. catalystbiosciences.com/phoenix.zhtml?c=254141&p=irol-newsArticle &ID=2200062, 2 pages.
Catalyst Biosciences Press Release, "Catalyst Biosciences Reports Third Quarter 2016 Financial Results and Provides Corporate Update," Published on Nov. 3, 2016 [online]; Retrieved on Jan. 17, 2017, from: <URL:ir.catalystbiosciences.com/phoenix.zhtml?c= 254141&p=irol-newsArticle&ID=2219137, 5 pages.
Catalyst Biosciences Press Release, "Catalyst Biosciences Completes Manufacturing Agreements for its Novel Factor VIIa Product, Marzeptacog alpha (activated)," Published on Dec. 19, 2016 [online]; Retrieved on Jan. 17, 2017, from: <URL:ir.catalystbiosciences.com/ phoenix.zhtml?c=254141&p=irol-newsArticle&ID=2230538>, 4 pages.
Catalyst Biosciences Press Release, "Catalyst Biosciences Announces Positive Preclinical Data of Subcutaneously Dosed Coagulation Factors VIIa and IX at EAHAD Annual Congress," Published Feb. 1, 2017 [online]; retrieved on Mar. 29, 2017, from: <URL:ir. catalystbiosciences.com/phoenix.zhtml?c=254141&p=irol-newsArticle &ID=2241233, 4 pages.
Catalyst Biosciences Press Release, "Catalyst Biosciences Announces 1-for-15 Reverse Stock Split," Published Feb. 10, 2017 [online]; retrieved on Mar. 29, 2017, from: <URL:ir.catalystbiosciences.com/ phoenix.zhtml?c=254141&p=irol-newsArticle&ID=2245124, 4 pages.
Catalyst Biosciences Press Release, "Catalyst Biosciences Highlights Hemophilia Clinical Development Plans at the 19th Annual BIO CEO & Investor Conference," Published Feb. 14, 2017 [online], retrieved Mar. 29, 2017 from: <URL:ir.catalystbiosciences.com/ phoenix.zhtml?c=254141&p=irol-newsArticle&ID=2245842, 3 pages.
Catalyst Biosciences Press Release, "Catalyst Biosciences Reports Fourth Quarter and Full Year 2016 Financial Results and Provides Corporate Update," Published Mar. 8, 2017 [online], retrieved on Mar. 29, 2017 from: <URL:ir.catalystbiosciences.com/phoenix. zhtml?c=254141&p=irol-newsArticle&ID=2252461, 5 pages.
Catalyst Biosciences Press Release, "Catalyst Biosciences Reports Fourth Quarter and Full-Year 2017 Operating & Financial Results and Provides Corporate Update," published Mar. 1, 2018 [online]; 5 pages.
Catalyst Biosciences, United States Securities and Exchange Commission filing, dated Mar. 19, 2018; Retrieved on Jul. 30, 2018, from: <URL:getfilings.com/sec-filings/180319/CATAL YST-BIOSCIENCES-INC 10-K/, 132 pages.
Catalyst Biosciences Presentation, entitled "Catalyst Biosciences: Essential Medicines for Hemophilia; Greater Convenience; Superior Outcomes," presented at the BIO CEO Conference on Feb. 12, 2018, 21 pages.
Catalyst Biosciences Press Release, "Catalyst Biosciences Announces Emergence from Key Patent Opposition Period Supporting Marzeptacog Alfa (activated), Catalyst's Lead Clinical Program," Published Mar. 30, 2017 [online], 3 pages.
Catalyst Biosciences Press Release, "Catalyst Biosciences Reports First Quarter 2017 Financial Results and Provides Corporate Update," Published May 11, 2017 [online]; retrieved on May 25, 2017 from <URL:ir.catalystbiosciences.com/phoenix.zhtml?c=254141&p=irol-newsArticle_print&ID=2272266, 5 pages.
Catalyst Biosciences Press Release, "Catalyst Biosciences Reports First Quarter Operating & Financial Results and Provides Corporate Update," published May 3, 2018 [ online]; retrieved on Jul. 17, 2018 from: <URL:ir.catalystbiosciences.com/phoenix.zhtml?c=254 1 4 1&p=irol-newsArticle&ID=2346752, 5 pages.
Catalyst Biosciences Press Release, "Catalyst Biosciences to Host Key Opinion Leader Meeting on Novel Treatments for Hemophilia B and Hemophilia with Inhibitors," published May 9, 2018 [online]; 3 pages.
Catalyst Biosciences, United States Securities and Exchange Commission filing, dated May 3, 2018; Retrieved on Jul. 31, 2018, from: <URL:getfilings.com/sec-filings/180503/CATALYST-BIOSCIENCES-INC 10-Q/, 32 pages.

(56) References Cited

OTHER PUBLICATIONS

Catalyst Biosciences Press Release, "Catalyst Biosciences Announces Presentations on its Next-Generation Subcutaneous Hemophilia Product Candidates at the 2017 International Society on Thrombosis and Haemostasis (ISTH) Meeting," Published Jun. 8, 2017 [online]; retrieved on Jul. 27, 2017 from <URL:ir.catalystbiosciences.com/phoenix.zhtml?c=254141&p=irol-newsArticle&ID=2279809, 3 pages.
Catalyst Biosciences Press Release, "Catalyst Biosciences Reports Third Quarter 2017 Operating & Financial Results and Provides Corporate Update," Published Nov. 2, 2017 [online]; retrieved on Jan. 30, 2018 from: <URL:ir.catalystbiosciences.com/phoenix.zhtml?c=254141&p=irol-newsArticle_print&ID=2313857, 3 pages.
Catalyst Biosciences Press Release, "Catalyst Biosciences Initiates Phase 2/3 Trial of Marzeptacog Alfa (activated) for Prophylaxis in Hemophilia A or B with Inhibitors," Published Jan. 4, 2018 [online]; retrieved on Jan. 30, 2018 from: <URL:ir.catalystbiosciences.com/phoenix.zhtml?c=254141&p=irol-newsArticie_print&ID=2324884, 3 pages.
Catalyst Biosciences, United States Securities and Exchange Commission filing, dated Mar. 9, 2016; Retrieved on Jul. 31, 2018, from: <URL:sec.gov/Archives/edgar/data/1124105/000119312516498295/dl 1701 ldlOk.htm, 109 pages.
Catalyst Biosciences, United States Securities and Exchange Commission filing, dated Mar. 8, 2017 [online]; 122 pages.
Catalyst Biosciences, United States Securities and Exchange Commission filing, dated Mar. 13, 2017 [online]; Retrieved on Aug. 1, 2018, from: <URL:sec.gov/Archives/edgar/data/1124105/000 1 19312517080510/d358624dsl.htm, 79 pages.
Catalyst Biosciences Press Release, "Catalyst Biosciences Announces Positive Interim Data from a Phase 2/3 Study of Marzeptacog Alfa (Activated) in Individuals with Hemophilia A or B with Inhibitors," published Jul. 18, 2018 [online]; retrieved on Jul. 20, 2018 from: <URL: ir. catalystbiosciences. com/phoenix.zhtml? c=254 1 4 1&p=irol-newsArticle&ID=23 5 8778, 4 pages.
Catalyst Biosciences Press Release, "Catalyst Biosciences Reports Second Quarter Operating & Financial Results and Provides Corporate Update," published Aug. 2, 2018 [ online]; retrieved on Oct. 3, 2018 from: <URL:ir.catalystbiosciences.com/news-releases/news-release-details/catalyst-biosciences-reports-second-quarter-operating-financial, 5 pages.
Catalyst Biosciences, United States Securities and Exchange Commission filing, dated Aug. 2, 2018; Retrieved on Oct. 3, 2018, from: <URL:ir.catalystbiosciences.com/static-files/7f3e8612-6609-4eab-84c2-5264ff7224dd, 56 pages.
Catalyst Biosciences Press Release, "Catalyst Biosciences Announces Updated Positive Interim Data at the 2018 Hemophilia Drug Development Summit," published Aug. 15, 2018 [online]; retrieved on Oct. 3, 2018 from: <URL:ir.catalystbiosciences.com/news-releases/news-release-details/catalyst-biosciences-announces-updated-positive-interim-data, 3 pages.
Catalyst Biosciences Press Release, "Catalyst Biosciences Announces Publication of Marzeptacog Alfa (Activated) Phase 1 Data in The Journal of Thrombosis and Haemostasis," published Sep. 4, 2018 [online]; retrieved on Oct. 3, 2018 from: <URL:ir.catalystbiosciences.com/news-releases/news-release-details/catalyst-biosciences-announces-publication-marzeptacog-alfa, 2 pages.
Catalyst Biosciences Press Release, "Catalyst Biosciences Reports Third Quarter Operating & Financial Results and Provides a Corporate Update," published Nov. 1, 2018 [ online]; retrieved on Dec. 7, 2018 from <URL:ir.catalystbiosciences.com/news-releases/news-release-details/catalyst-biosciences-reports-third-quarter-operating-financial. 5 pages.
Catalyst Biosciences Press Release, "Catalyst Biosciences Announces Updated Positive Interim Data from Its Phase 2/3 Study of Marzeptacog Alfa (Activated) in Individuals with Hemophilia A or B with Inhibitors," published Dec. 1, 2018 [online]; 3 pages.
Chafa et al., "Homozygous nonsense mutation (Cys72 →stop) in the human F7 gene: a not life-threatening mutation despite the absence of circulating factor VII," J. Thromb. Haemost. 3(1):175-177 (2005).
Chaing et al., "Severe factor VII deficiency caused by mutations abolishing the cleavage site for activation and altering binding to tissue factor," Blood 83(12):3524-3535 (1994).
Chan et al., "Assessment of recombinant factor VIIa as an antidote for bleeding induced in the rabbit by low molecular weight heparin," J Thromb Haemost 1:760-765 (2003).
Chang et al., "Engineered recombinant factor VII Q217 variants with altered inhibitor specificities," Biochemistry 38:10940-10948 (1999).
Chang et al., "The roles of factor VII's structural domains in tissue factor binding," Biochem. 34(38):12227-12232 (1995).
Cheung et al., "Localization of a metal-dependent epitope to the amino terminal residues 33-40 of human factor IX," Thrombosis Res. 80(5):419-427 (1995).
Clarke, B. and M. Blajchman. "Human FVII(K62E) does not exhibit enhanced binding to tissue factor," J Thromb Haemost. 6(7):1229 (2008).
Craik et al., "Proteases as therapeutics," Biochem. J. 435:1-16(2011).
Cutler et al., "The significance of published polymorphisms in 14 cases of mild factor VII deficiency," Blood Coag. Fibrin. 16:91-95 (2005).
D'Andrea et al., "Molecular characterization of a factor VII deficient patient supports the importance of the second epidermal growth factor-like domain," Haematologica 89(8):979-984 (2004).
DeBoer et al., "The tac promoter: a functional hybrid derived from the trp and lac promoters," Proc. Natl. Acad. Sci. USA 80:21-25 (1983).
Deveras et al., "Reversal of warfarin-induced excessive anticoagulation with recombinant human factor VIIa concentrate," Ann Inten Med 137:884-888 (2002).
Devereux et al., "A comprehensive set of sequence analysis programs for the VAX," Nucleic Acids Research 12(I): 387 (1984).
Dickinson et al., "Identification of surface residues mediating tissue factor binding and catalytic function of the serine protease factor VIIa," Proc. Nat. Acad. Sci. USA. 93:14379-14384 (1996).
Dickinson et al., "Active site modification of factor VIIa affects interactions of the protease domain with tissue factor," J Biol Chem 272(32):19875-19879 (1997).
Diness et al., "Recombinant human factor VIIa (rFVIIa) in a rabbit stasis model," Thromb Res 67:233-241 (1992).
Eisenberg et al., "Hydrophobic moments and protein structure," Faraday Symp. Chem. Soc. 17:109-120 (1982).
Eigenbrot et al., "The Factor VII Zymogen structure reveals reregistration of β Strands during Activation," 9:627-636 (2001).
Elg et al., "Effect of activated prothrombin complex concentrate or recombinant factor VIIa on the bleeding time and thrombus formation during anticoagulation with a direct thrombin inhibitor," Thromb Res 101:145-157 (2001).
Extended European Search Report, dated Dec. 4, 2013, in connection with corresponding European Patent Application No. 13162174.0, 9 pages.
Extended European Search Report, dated Mar. 25, 2014, in connection with corresponding European Patent Application Serial No. 13162166.6, 12 pages.
Etro et al., "The Gly331Ser mutation in factor VII in Europe and the Middle East," J. Hematol. 88(12):1434-1436 (2005).
Fattorutto et al., "Recombinant activated factor VII decreases bleeding without increasing arterial thrombosis in rabbits," Can J Anaesth 51:672-679 (2004).
Friederich et al., "Effect of recombinant activated factor VII on perioperative blood loss in patients undergoing retropubic prostatectomy: a double-blind placebo-controlled randomised trial," Lancet 361:201-205 (2003).
Fromovich-Amit et al., "Characterization of mutations causing factor VII deficiency in 61 unrelated Israeli patients," J. Thromb. Haemost. 2(10):1774-1781 (2004).
Furlan Freguia et al., "Comparison among natural ($Arg^{304}Gln$, $Arg^{304}Trp$) and artificial ($Arg^{290}His$, $Arg^{290}Lys$) mutations in coagulation factor VII loops," J. Thromb. Haemost. 1(11):2455-2457 (2003).

(56) References Cited

OTHER PUBLICATIONS

Furlan Freguia et al., "Characterization of mild coagulation factor VII deficiency: activity and clearance of the Arg$^{315}$Trp and Arg$^{315}$Lys variants in the Cys$^{310}$-Cys$^{329}$ loop (c170s)," Haematologica 89(12):1504-1509 (2004).
Gardner et al., "The complete nucleotide sequence of an infectious clone of cauliflower mosaic virus by M13mp7 shotgun sequencing," Nucleic Acids Res. 9:2871 (1981).
GenBank Accession No. NM_000131 Nucleotide (accessed on Jul. 21, 2008) (7 pages).
GenBank Accession No. NM_019616 Nucleotide (accessed on Jul. 21, 2008) (7 pages).
Geng et al., "Properties of a recombinant chimeric protein in which the gamma-carboxyglutamic acid and helical stack domains of human anticoagulant protein C are replaced by those of human coagulation factor VII," Thromb Haemost 77:926-933 (1997).
Gerlach et al., "Application of recombinant activated factor VII during surgery for a giant skull base hemangiopericytoma to achieve safe hemostasis. Case report," J Neurosurg 96:946-948 (2002).
Gerotziafas et al., "Effective hemostasis with rFVIIa treatment in two patients with severe thrombocytopenia and life-threatening hemomrhage," Am J Hematol 69:219-222 (2002).
Ghosh et al., transcript of presentation at the Am. Society. Hematol. Meeting, Dec. 10, 2007.
Ghosh et al., "Activity and regulation of factor VIIa analogs with increased potency at the endothelial cell surface," J. Thromb. Haemost. 5(2):336-346 (2007).
Giansily-Blaizot et al., "Analysis of the genotypes and phenotypes of 37 unrelated patients with inherited factor VII deficiency," Eur. J. Hum. Genet. 9:105-112(2001).
Giannelli et al., "Haemophilia B: database of point mutations and short additions and deletions, fifth edition, 1994," Nucleic Acids Research 22(17):3534-3546 (1994).
Gilbert et al., "Useful Proteins from Recombinant Bacteria," Scientific American 242:79-94 (1980).
Gribskov et al., "Sigma factors from *E. coli*, B. subtilis, phage SP01, and phage T4 are homologous proteins," Nucl. Acids Res. 14: 6745-6763 (1986).
Grosschedl et al., "Introduction of a mu immunoglobulin gene into the mouse germ line: specific expression in lymphoid cells and synthesis of functional antibody," Cell 38:647-658 (1984).
Gruppo et al., Catalyst Biosciences Presentation, "Safety, pharmacokinetics and pharmacodynamics of PF-05280602 (recombinant FVIIa variant): results from a single ascending dose phase I study in hemophilia A and B subjects," Abstract P0266, presented at the International Society on Thrombosis and Haemostasis (ISTH) Meeting, Toronto, Canada, on Jun. 24, 2015, 1 page.
Hahn et al., "Population genetic and phylogenetic evidence for positive selection on regulatory mutations at the factor VII locus in humans," Genetics 167(2):867-877 (2004).
Hammer et al., "Diversity of alpha-fetoprotein gene expression in mice is generated by a combination of separate enhancer elements," Science 235:53-58 (1987).
Hanahan et al., "Heritable formation of pancreatic beta-cell tumours in transgenic mice expressing recombinant insulin/simian virus 40 oncogenes," Nature 315:115-122 (1985).
Harvey et al., "Mutagenesis of the gamma-carboxyglutamic acid domain of human factor VII to generate maximum enhancement of the membrane contact site," J. Biol. Chem. 278:8363-8369. (2003).
Herrara-Estrella et al., "Expression of chimaeric genes transferred into plant cells using a Ti-plasmid-derived vector," Nature 303:209-213 (1983).
Herrera-Estrella et al., "Light-inducible and chloroplast-associated expression of a chimaeric gene introduced into Nicotiana tabacum using a Ti plasmid vector," Nature 310:115-120 (1984).
Hemker et al.,"Platelet membrane involvement in blood coagulation," Blood Cells 9:303-317 (1983).

Henderson et al., "Response of factor VIII and IX-deficient blood to wild type and high membrane affinity mutant factor VIIa in an in vitro whole blood clotting assay: possible correlation to clinical outcome," Thromb. Haemost. 88:98-103 (2002).
Herrmann et al., "International Greifswald Registry of FVII deficiency. Variability of clinical manifestation of factor VII-deficiency in homozygous and heterozygous subjects of the European F7 gene mutation A294V," Haematologica. 93(8):1273-1275 (2008).
Hicks et al., "Treatment of diffuse alveolar hemorrhage after allogeneic bone marrow transplant with recombinant factor VIIa," Bone Marrow Transpl 30:975-978 (2002).
Higashi et al., "Molecular mechanism of tissue factor-mediated acceleration of factor VIIa activity," J Biol Chem 271:26569-26574 (1996).
Higashi et al., Identification of Regions of Bovine Factor VII essential for binding to tissue factor, J. Biol. Chem 269(29):18891-18898 (1994).
Himmelspach et al., "Recombinant human factor X: high yield expression and the role of furin in proteolytic maturation in vivo and in vitro," Thromb Research 97; 51-67 (2000).
Hoffman et al., "Activated factor VII activates factors IX and X on the surface of activated platelets: thoughts on the mechanism of action of high-dose activated factor VII," Blood Coagul Fibrinolysis 9:S61-S65 (1998).
Hoffman et al., "A cell-based model of hemostasis," Thromb Haemost 85:958-965 (2001).
Hunault et al., "Characterization of two naturally occurring mutations in the second epidermal growth factor-like domain of factor VII," Blood 93(4):1237-1244 (1999).
Hunault et al., "Mechanism underlying factor VII deficiency in Jewish populations with the Ala$^{244}$Val mutation," Br. J. Haematol. 105(4):1101-1108 (1999).
Iakhiaev et al., "The role of catalytic cleft and exosite residues of factor VIIa for complex formation with tissue factor pathway inhibitor," Thromb. Haemost. 85:458-463. (2001).
Iino et al., "Functional consequences of mutations in Ser-52 and Ser-60 in human blood coagulation factor VII," Arch. Biochem. Biophys. 352(2):182-192 (1998).
International Search Report and Written Opinion, dated Jan. 19, 2009, in connection with related International Patent Application No. PCT/US2008/004795, 14 pages.
International Search Report and Written Opinion, dated Oct. 23, 2009, in connection with corresponding International Patent Application No. PCT/US2009/002248, 32 pages.
International Search Report and Written Opinion, dated Nov. 9, 2020, in connection with corresponding International Patent Application No. PCT/US2020/046577, 12 pages.
IUPAC-IUB, "Commission on biochemical nomenclature. A one-letter notation for amino acid sequences. Tentative rules," J. Biol. Chem. 243:3557-3559 (1968).
IUPAC-IUB, "Commission on biochemical nonmenclature symbols for amino-acid derivatives and peptides recommendations," Nomenclature Biochem. 11:1726-1732 (1972).
Jay et al., "Construction of a general vector for efficient expression of mammalian proteins in bacteria: use of a synthetic ribosome binding site," Proc. Natl. Acad. Sci. USA 78:5543-5548 (1981).
Jin et al., "Four loops of the catalytic domain of factor viia mediate the effect of the first EGF-like domain substitution on factor viia calalytic activity," J Mol Biol, 307: 1503-1517 (2001).
Jin et al., "Factor VIIa's first epidermal growth factor-like domain's role in catalytic activity," Biochem. 38:1185-1192 (1999).
Jurlander et al., "Recombinant activated factor VII (rFVIIa): characterization, manufacturing, and clinical development," Semin Thromb Hemost 27:373-384 (2001).
Kastrup et al., "Recombinant factor VIIa after aortic valve replacement in a patient with osteogenesis imperfecta," Ann Thorac Surg 74:910-912 (2002).
Katsumi et al., "Severe factor VII deficiency caused by a novel mutation His$^{348}$ to Gln in the catalytic domain," Thromb. Haemost. 83(2):239-243 (2000).
Kavlie et al., "Characterization of a factor VII molecule carrying a mutation in the second epidermal growth factor-like domain," Thromb. Haemost. 79(6):1136-1143 (1998).

(56) References Cited

OTHER PUBLICATIONS

Kavlie et al., "A novel gene mutation in the 60s loop of human coagulation factor VII—inhibition of interdomain crosstalk," Thromb. Haemost. 91(1):28-37 (2004).
Kelsey et al., "Species- and tissue-specific expression of human alpha 1-antitrypsin in transgenic mice," Genes and Devel. 1:161-171 (1987).
Kemball-Cook et al., "Coagulation factor VII Gln100 --> Arg. Amino acid substitution at the epidermal growth factor 2-protease domain interface results in severely reduced tissue factor binding and procoagulant function," J Biol Chem 273:8516-8521 (1998).
Kenet et al., "Treatment of traumatic bleeding with recombinant factor VIIa," Lancet 354:1879 (1999).
Ketner et al., "Efficient manipulation of the human adenovirus genome as an infectious yeast artificial chromosome clone," PNAS 91:6186-6190 (1994).
Khalilzadeh et al., "Process development for production of recombinant human interferon-gamma expressed in *Escherichia coli*," J. Ind. Microbiol. Biotechnol. 31(2): 63-69 (2004).
Koeberl et al., "Functionally important regions of the factor IX gene have a low rate of polymorphism and a high rate of mutation in the dinucleotide CpG," Am. J. Hum. Genet. 45:448-457 (1989).
Kollias et al., "Regulated expression of human A gamma-, beta-, and hybrid gamma beta-globin genes in transgenic mice: manipulation of the developmental expression patterns," Cell 46:89-94 (1986).
Kornfelt et al., "Oxidation of methionine residues in coagulation Factor VIIa," Archives of Biochem. and Biophys. 363(1):43-54 (1999).
Krumlauf et al., "Developmental regulation of alpha-fetoprotein genes in transgenic mice," Mol. Cell. Biol. 5:1639-1648 (1985).
Krishnaswamy et al., "Regulation of extrinsic pathway factor Xa formation by tissue factor pathway inhibitor," J Biol Chem. 273(8):4378-4386 (1998).
Lamba et al. "The 2.3 Å crystal structure of the catalytic domain of recombinant two-chain human tissue-type plasminogen activator," J. Mol. Biol. 258:117-135 (1996).
Lauritzen et al., "rFVIIa and a new enhanced rFVIIa-analogue, NN1731, areduce bleeding in clopidogrel-treated and in thrombocytopenic rats," J. Thrombosis and Haemostasis. 7:651-657 (2009).
Larsen et al., "Engineering the substrate and inhibitor specificities of human coagulation Factor VIIa," Biochem J. 405(3):429-438 (2007).
Leder et al., "Consequences of widespread deregulation of the c-myc gene in transgenic mice: multiple neoplasms and normal development," Cell 45:485-495 (1986).
Lee et al., "Compound heterozygous mutations in severe factor VII deficiency including a novel nonsense mutation," Blood Coagul Fibrinolysis. 19(1):92-94 (2008).
Lee et al. (1995). "A single amino acid in the SH3 domain of Hck determines its high affinity and specificity in binding to HIV-1 Nef Protein,"The EMBO Journal 14:5006-5015.
Lee et al., "Recent Estimates of the Structure of the Factor VIIa (FVIIa)/Tissue Factor (TF) and Factor Xa (Fxa) Ternary Complex," Thromb. Res. 125SI: S7-S10 (2010).
Leonard et al., "Factor VII deficiency caused by a structural variant N57D of the first epidermal growth factor domain," Blood 91(1):142-148 (1998).
Levy et al., "Pharmacokinetics and Pharmacodynamics of Daily Subcutaneously Administered Marzeptacog Alfa (Activated) in Hemophilia Dogs," Poster # 076, presented at the European Association for Haemophilia and Allied Disorders (EAHAD) 10th Annual Congress, Paris, France, Feb. 1, 2017, 1 page.
Levy et al., Catalyst Biosciences Presentation, entitled "Phase 2/3 Trial of Subcutaneously Administered Novel FVIIa Variant, Marzeptacog alfa (activated), in Hemophilia A or B with Inhibitors: Pharmacokinetics, Pharmacodynamics, Safety and Efficacy," Abstract PB 196, presented at the 64th Annual Scientific and Standardization Committee (SSC) Meeting of the International Society on Thrombosis and Haemostasis (ISTH), in Dublin, Ireland, on Jul. 18, 2018, 1 page.

Levy, H., Catalyst Biosciences Presentation, entitled "Subcutaneous Delivery of Coagulation Factors," presented at the 2018 Hemophilia Drug Development Sununit, Boston, USA, on Aug. 15, 2018, 32 pages.
Levy et al., Catalyst Biosciences Poster entitled "Phase 2/3 Trial of Subcutaneously Administered Marzeptacog Alfa (Activated) An Engineered FVIIa In Hemophilia With Inhibitors—Pharmacokinetics, Pharmacodynamics, Safety and Efficacy," Presented on Dec. 1, 2018, at the 60th American Society of Hematology Annual Meeting & Exposition in San Diego, CA, 1 page.
Levy et al., Abstract No. 1198, for Poster Presentation entitled "Phase 2/3 Trial of Subcutaneously Administered Marzeptacog Alfa (Activated) an Engineered FVIIa in Hemophilia With Inhibitors—Pharmacokinetics, Pharmacodynamics, Safety and Efficacy," Presented on Dec. 1, 2018 at the 60th American Society of Hematology Annual Meeting & Exposition, in San Diego, CA; retrieved Dec. 7, 2018 from <URL:ash.confex.com/ash/2018/webprogram!PaperI 12567.html , 3 pages.
Liebman et al., "Immunoaffinity purification of factor IX (Christmas factor) by using conformation-specific antibodies directed against the factor IX-metal complex," Proc. Nat. Acad. Sci. USA., 82:3879-3883 (1985).
Lin et al., "Binding of the factor IX gamma-carboxyglutamic acid domain to toe vitamin K-dependent gamma-glutamyl carboxylase active site induces an allosteric effect that may ensure processive carboxylation and regulate the release of carboxylated product," J Biol Chem 279:6560-6566 (2004).
Lindenbaum et al., "A mammalian artificial chromosome engineering system (ACE System) applicable to biopharmaceutical protein production, transgenesis and gene-based cell therapy," Nucleic Acids Res. 32(21):e172 (2004).
Lynn et al., "Early use of recombinant factor VIIa improves mean arterial pressure and may potentially decrease mortality in experimental hemorrhagic shock: a pilot study," J Trauma 52:703-707 (2002).
Magram et al., "Developmental regulation of a cloned adult beta-globin gene in transgenic mice," Nature 315:338-340 (1985).
Madison et al., "Engineering factor VIIa molecules with improved therapeutic properties for treatment of patients with inhibitors," Haemophilia 16(Supp. 4):75, Abstract 17P48 (2010).
Mariani et al., "Clinical phenotypes and factor VII genotype in congenital factor VII deficiency," Thromb. Haemost. 3:481-487 (2005).
Mariani et al., "Molecular and clinical aspects of factor VII deficiency," Blood Coag. Fibrin. 9(suppl):S83-S88 (1998).
Martinowitz et al., "Intravenous rFVIIa administered for hemorrhage control in hypothermic coagulopathic swine with grade V liver injuries," J Trauma 50:721-729 (2001).
Maguire et al., "Polymorphisms in platelet glycoprotein 1b alpha and factor VII and risk of ischemic stroke:a meta-analysis," Stroke. 39(6):1710-1716 (2008).
Margaritis et al., "Novel therapeutic approach for hemophilia using gene delivery of an engineered secreted activated Factor VII," J Clin Invest 113:1025-1031 (2004).
Mason et al., "The hypogonadal mouse: reproductive functions restored by gene therapy," Science 234:1372-1378(1986).
Matsushita et al., "Impaired human tissue factor-mediated activity in blood clotting factor VII$_{Nagoya}$ (Arg$^{304}$ → Trp)," J. Biol. Chem. 269(10):7355-7363 (1994).
Maun et al., "Disulfide locked variants of factor VIIa with a restricted beta-strand conformation have enhanced enzymatic activity," Prot Sci 14:1171-1180 (2005).
Mayfield et al., "Expression and assembly of a fully active antibody in algae," Proc. Nat. Acad. Sci. USA., 100:438-442 (2003).
McVey et al., "Factor VII Deficiency and the FVII Mutation Database," Human Mutation 17(1):3-17 (2001).
Melton et al., "Location of the platelet binding site in zymogen coagulation factor IX," Blood Coagul. Fibrin. 12(4):237-243 (2001).
Menegatti et al., "A rare inherited coagulation disorder: combined homozygous factor VII and factor X deficiency," Am. J. Hematol. 77(1):90-91 (2004).

(56) References Cited

OTHER PUBLICATIONS

Millar et al., "Molecular analysis of the genotype-phenotype relationship in factor VII deficiency," Hum. Genet.107(4):327-342 (2000).
Monroe et al., "Platelet activity of high-dose factor VIIa is independent of tissue factor," Br J Haematol 99:542-547 (1997).
Moscardo et al., "Successful treatment of severe intra-abdominal bleeding associated with disseminated intravascular coagulation using recombinant activated factor VII," Br J Haematol 113:174-176 (2001).
Moss et al., "Evaluation of the safety and pharmakokinetics of a fast-acting recombinant FVIIa analogue, NN1731, in healthy male subjects," J. Thrombosis and Haemostasis, 7:299-305 (2009).
Muneta et al., "Large-scale production of porcine mature interleukin-18 (IL-18) in silkworms using a hybrid baculovirus expression system," J Vet Med Sci. 65(2):219-223 (2003).
Nakagaki et al., "Initiation of the extrinsic pathway of blood coagulation: evidence for the tissue factor dependent autoactivation of human coagulation factor VII," Biochemistry. 30(45):10819-10824 (1991).
Ndonwi et al., "Substitution of the Gla domain in factor X with that of protein C impairs its interaction with factor VIIa/tissue factor," J. Biol. Chem. 282(21):15632-15644 (2007).
Nelsestuen et al., "Enhancement of vitamin-K-dependent protein function by modification of the gamma-carboxyglutamic acid domain: studies of protein C and factor VII," Trends Cardiovasc Med. 9(6):162-167 (1999).
Nelsestuen et al., "Elevated function of blood clotting factor VIIa mutants that have enhanced affinity for membranes. Behavior in a diffusion-limited reaction," J Biol Chem. 276(43):39825-39831 (2001).
Needleman et al., "A general method applicable to the search for similarities in the amino acid sequence of two proteins," J Mol Biol. 48(3):443-453 (1970).
Neuenschwander, P. and J. Morrissey, "Alteration of the substrate and inhibitor specificities of blood coagulation factor VIIa: importance of amino acid residue K192," Biochemistry. 34(27):8701-8707 (1995).
Neuenschwander, P. and J. Morrissey, "Roles of the membrane-interactive regions of factor VIIa and tissue factor," J. Biol. Chem. 269(11):8007-8013 (1994).
Norledge et al., "The Tissue Factor/Factor VIIa/Factor Xa Complex:A Model Built by Docking and Site-Directed Mutagenesis," Proteins 53: 640-648 (2003).
O'Brien et al., "Structural requirements for the interaction between Tissue Factor and Factor VII: characterization of chymotrypsin-derived Tissue Factor polypeptides," Biochem. J. 292:7-12 (1993).
O'Brien et al., "Surface plasmon resonance studies of the interaction between factor VII and tissue factor. Demonstration of defective tissue factor binding in a variant FVII molecule (FVII-R79Q)," Biochemistry. 33(47):14162-14169 (1994).
Olomu et al., "Treatment of severe pulmonary hemorrhage with activated recombinant factor VII (rFVIIa) in very low birth weight infants," J Perinatol. 22(8):672-674 (2002).
Olson et al., "Accelerating ability of synthetic oligosaccharides on antithrombin inhibition of proteinases of the clotting and fibrinolytic systems. Comparison with heparin and low-molecular-weight heparin." Thromb Haemost 92(5):929-939 (2004).
Olsen et al., "Prevention of βstrand movement into a zymogen-like position does not confer higher activity to coagulation factor VIIa," Biochem. 43:14096-14103 (2004).
Ornitz et al., "Elastase I promoter directs expression of human growth hormone and SV40 T antigen genes to pancreatic acinar cells in transgenic mice," Cold Spring Harbor Symp. Quant. Biol. 50:399-409 (1986).
Osterlund et al., "Spectroscopic probing of the influence of calcium and the gla domain on the interaction between the first EGF domain in factor VIIa and tissue factor," Eur J Biochem 267:6204-6211 (2000).
Partial European Search Report, dated Dec. 4, 2013, in connection with corresponding European Patent Application No. 13162166.6, 10 pages.
Pedersen et al., "Recombinant human extrinsic pathway inhibitor. Production, isolation, and characterization of its inhibitory activity on tissue factor-initiated coagulation reactions," J Biol. Chem. 265:16786-16793(1990).
Perera et al., "Predicted solution structure of Zymogen Human Coagulation FVII," J Comput Chem 23: 35-47 (2002).
Persson E. "Variants of recombinant factor VIIa with increased Intrinsic Activity." Semin Hematol. 41(1 Suppl 1):89-92 (2004).
Persson et al., "Assignment of molecular properties of a superactive coagulation factor VIIa variant to individual amino acid changes," Eur J Biochem 269:5950-5955 (2002).
Persson et al., "Augmented intrinsic activity of Factor VIIa by replacement of residues 305, 314, 337 and 374: evidence of two unique mutational mechanisms of activity enhancement," Biochem J., 379: 497-503 (20041.
Persson et al., "Rational design of coagulation factor VIIa variants with substantially increased intrinsic activity." Proc. Nat. Acad. Sci. USA. 98:13583-13588 (2001).
Persson, E., "Protein disulfide isomerase has no stimulatory chaperone effect on factor X activation by factor VIIa-soluble tissue factor," Thromb Res. 123(1):171-176 (2008).
Persson et al., "Substitution of aspartic acid for methionine-306 in factor VIIa abolishes the allosteric linkage between the active site and the binding interface with tissue factor," Biochem. 40:3251-3256 (2001).
Pearson et al., "Improved tools for biological sequence comparison," Proc. Natl. Acad. Sci. USA 85: 2444-2448 (1988).
Petersen et al., "Binding of Zn2+ to a Ca2+ loop allosterically attenuates the activity of factor VIIa and reduces its affinity for tissue factor," Protein Science 9:859-866 (2000).
Petrovan, R. and W. Ruf, "Residue Met(156) contributes to the labile enzyme conformation of coagulation factor VIIa," J Biol Chem. 276(9):6616-6620 (2001).
Petrovan et al., "Role of residue Phe225 in the cofactor-mediated, allosteric regulation of the serine protease coagulation factor VIIa," Biochem. 39:14457-14463 (2000).
Petrovan et al., "Role of zymogenicity-determining residues of coagulation factor VII/VIIa in cofactor interaction and macromolecular substrate recognition," Biochem. 41:9302-9309 (2002).
Peyvandi et al., "Molecular characterisation and three-dimensional structural analysis of mutations in 21 unrelated families with inhereited factor VII deficiency," Thromb. Haemost. 84(2):250-257 (2000).
Peyvandi et al., "Two naturally occurring mutations on FVII gene (S363I-W364C) altering intrinsic catalytic activity," Thromb. Haemost. 88(5):750-755 (2002).
Pham et al., "Large-scale transient transfection of serum-free suspension-growing HEK293 EBNA1 cells: peptone additives improve cell growth and transfection efficiency," Biotechnol. Bioeng. 84:332-342 (2003).
Pinkert et al., "An albumin enhancer located 10 kb upstream functions along with its promoter to direct efficient liver-specific expression in transgenic mice," Genes and Devel. 1:268-276 (1987).
Pike et al., "Structure of human factor VIIa and its implications for the triggering of blood coagulation," Proc. Nat. Acad. Sci. USA. 8925-8930 (1999).
Pipe, S., "The promise and challenges of bioengineered recombinant clotting factors," J. Thromb. Haemost. 3: 1692-1701 (2005).
Platis et al., "High yield expression, refolding, and characterization of recombinant interferon alpha2/alpha8 hybrids in *Escherichia coli*," Protein Exp. Purif. 31(2): 222-230 (2003).
Przysiecki et al., "Occurrence of beta-hydroxylated asparagine residues in non-vitamin K-dependent proteins containing epidermal growth factor-like domains," PNAS 84:7856-7860 (1987).
Pusateri et al., "Mechanistic implications for the use and monitoring of recombinant activated factor VII in trauma," Critical Care 9:S15-S24 (2005).

(56) References Cited

OTHER PUBLICATIONS

Rand et al., "The origins of enhanced activity in factor VIIa analogs and the interplay between key allosteric sites revealed by hydrogen exchange mass spectrometry," J Biol Chem. 283(19):13378-13387 (2008).
Rao et al., "Factor VIIa-catalyzed activation of factor X independent of tissue factor: its possible significance for control of hemophilic bleeding by infused factor VIIa," Blood 75(5):1069-1073 (1990).
Rao et al., "Binding of factor VIIa to tissue factor permits rapid antithrombin III/heparin inhibition of factor VIIa," Blood 81:2600-2607 (1993).
Ratko et al., "Off-label use of recombinant activated factor VII (NovoSeven)," P & T 29:712-720 (2004).
Readhead et al., "Expression of a myelin basic protein gene in transgenic shiverer mice: correction of the dysmyelinating phenotype," Cell 48:703-712 (1987).
Reiner et al., "Coagulation factor VII gene haplotypes, obesity-related traits, and cardiovascular risk in young women," J. Thromb. Haemost. 5:42-49 (2007).
Renatus et al., "Lysine 156 promotes the anomalous proenzyme activity of tPA: X-ray crystal structure of single-chain human tPA," EMBO 16(16):4797-4805 (1997).
Rizoli et al., "Recombinant activated factor VII as an adjunctive therapy for bleeding control in severe trauma patients with coagulopathy: subgroup analysis from two randomized trials," Crit Care 10:R178 (2006).
Ruan et al., "Overexpression of BsoBI restriction endonuclease in *E. coli*, purification of the recombinant BsoBI, and identification of catalytic residues of BsoBI by random mutagenesis," Gene 188:35-39(1997).
Ruf, W. "Factor VIIa residue Arg$^{290}$ is required for efficient activation of the macromolecular substrate factor X" Biochemistry 33:11631-11636 (1994).
Ruf et al., "Importance of factor VIIa Gla-domain residue Arg-36 for recognition of the macromolecular substrate factor X Gla-domain," Biochemistry 38:1957-1966 (1999).
Ruggeri, "Platelets in atherothrombosis," Nat Med 8:1227-1234 (2002).
Sajdak et al., "Bleeding from endometrial and vaginal malignant tumors treated with activated recombinant factor VII," Eur J Gynaecol Oncol 23:325-326 (2002).
Savage et al., "Mechanisms of platelet aggregation," Curr Opin Hematol 8:270-276 (2001).
Schwartz and Dayhoff, eds., Atlas of Protein Sequence and Structure, National Biomedical Research Foundation, pp. 353-358 (1979).
Sergel et al., "A single amino acid change in the Newcastle disease virus fusion protein alters the requirement for HN protein infusion," J. Virol. 74(11):5101-5107 (2000).
Shah et al., "Manipulation of the membrane binding site of vitamin K-dependent proteins: enhanced biological function of human factor VII," Proc. Nat. Acad. Sci. USA. 95:4229-4234 (1998).
Shami et al. Recombinant activated factor VII for coagulopathy in fulminant hepatic failure compared with conventional therapy. Liver Transpl 9:138-143 (2003).
Shani, "Tissue-specific expression of rat myosin light-chain 2 gene in transgenic mice," Nature 314:283-286 (1985).
Shikata et al., "Association of pharmacokinetic (CYP2C9) and pharmacodynamic (factors II, VII, IX, and X; proteins S and C; and γ-glutamyl carboxylase) gene variants with warfarin sensitivity." Haemost. Thromb. Vase, Biol. 103(7):2630-2635 (2004).
Shobe et al., "Regulation of the catalytic function of coagulation factor VIIa by a conformational linkage of surface residue Glu 154 to the active site," Biochem. 38:2745-2751 (1999).
Skoko et al., "Expression and characterization of human interferon-beta1 in the methylotrophic yeast *Pichia pastoris*," Biotechnol. Appl. Biochem. 38(Pt3):257-265 (2003).
Smith et al., "Protein loop grafting to construct a variant of tissue-type plasminogen activator that binds platelet integrin alpha IIb beta 3," J. Biol. Chem. 270:486-490 (1995).

Smith, T. and M. Waterman, "Comparison of biosequences," Adv. Appl. Math. 2:482 (1981).
Soejima et al.," Factor VIIa modified in the 170 loop shows enhanced catalytic activity but does not change the zymogen-like property," J Biol Chem 276:17229-17235 (2001).
Soejima et al., "The 99 and 170 loop-modified factor VIIa mutants show enhanced catalytic activity without tissue factor," J Biol Chem 277:49027-49035 (2002).
Sommer et al., "Immunogenicity of novel recombinant human activated factor VII analogues on factor VII neonatally-tolerized rats," Thromb Haemost. 98(4):721-725 (2007).
Sondeen et al., "Recombinant factor VIIa increases the pressure at which rebleeding occurs in porcine uncontrolled aortic hemorrhage model," Shock 22:163-168 (2004).
Soriano-Garcia et al., "Structure of Ca2+ prothrombin fragment 1 including the conformation of the Gla domain," Biochem. 28(17):6805-6810 (1989).
Srour et al., "Regulation of human factor IX expression using doxycycline-inducible gene expression system," Thromb Haemost. 90(3): 398-405 (2003).
Stone et al., "Large enhancement of functional activity of active site-inhibited factor VIIa due to protein dimerization: insights into mechanism of assembly/disassembly from tissue factor," Biochem. 44:6321-6330 (2005).
Swift et al., "Tissue-specific expression of the rat pancreatic elastase I gene in transgenic mice," Cell 38:639-646 (1984).
Sun et al., "Gla domain-mutated human protein C exhibiting enhanced anticoagulant activity and increased phospholipid binding," Blood 101:2277-2284 (2003).
Taboureau et al., "Computational study of coagulation factor VIIa's affinity for phospholipid membranes," Eur. Biophys. J. 36:133-144 (2007).
Tachias, K. and E. Madison, "Converting tissue-type plasminogen activator into a zymogen," J. Biol. Chem. 272(1):28-31 (1997).
Takamiya et al., "Human factor VII deficiency caused by S339C mutation located adjacent to the specificity pocket of the catalytic domain," Clin. Lab. Haematol. 24(4):233-238 (2002).
Takamiya et al., "Molecular mechanism of dysfunctional factor VII associated with the homozygous missense mutation 331Gly to Ser," Thromb. Haemost. 93(3):414-419 (2005).
The Expert Declaration of Dr. Ed Madison, dated Jun. 17, 2016, 2 pages.
Toso et al., "Factor VII mutant V154G models a zymmogen-like form of Factor VIIa," Biochem. J. 369: 563-571 (2003).
Tranholm et al., "Improved hemostasis with superactive analogs of factor VIIa in a mouse model of themophilia A," Blood 102:3615-3620 (2003).
Tranholm et al., "Recombinant factor VIIa reduces bleeding in severely thrombocytopenic rabbits," Thromb Res 109:217-223 (2003).
Uniprot accession No. P08709, "FA7_HUMAN," Published on Jan. 1, 1998 [online][retrieved on Apr. 24, 2009]; Retrieved from:<URL:uniprot.org/uniprot/P08709 (24 pages).
Usman, N., Catalyst Biosciences Investor Presentation, presented at the H.C. Wainwright & Co. 20th Annual Global Investment Conference, New York, USA, on Sep. 5, 2018, 25 pages.
Usman, N., Catalyst Biosciences Investor Presentation, presented at the 2018 Cantor Fitzgerald Global Healthcare Conference, New York, USA, on Oct. 1, 2018, and the Ladenburg Thalmann 4th Annual Healthcare Conference, New York, USA, on Oct. 2, 2018, 25 pages.
Usman, N., Catalyst Biosciences Presentation, entitled "Catalyst Biosciences: Essential Medicines for Hemophilia; Greater Convenience; Superior Outcomes," presented at the JMP Securities 2018 Life Sciences Conference, New York, USA, on Jun. 21, 2018, 23 pages.
Van Buuren et al., "Successful surgery using recombinant factor VIIa for recurrent, idiopathic nonulcer duodenal bleeding in a patient with Glanzmann's thrombasthenia," Dig Dis Sci 47:2134-2136 (2002).
Venkateswariu et al., "An all-atom solution-equilibrated model for human extrinsic blood coagulation complex (sTF-VIIa-Xa): a protein-protein docking and molecular dynamics refinement study," J. Thromb Haemost. 1:2577-2588 (2003).

(56) References Cited

OTHER PUBLICATIONS

Vermeer, C., "γ-Carboxyglutamate-containing proteins and the vitamin-K dependent carboxylase," Biochem. J. 266:625-636 (1990).
Vlot et al., "Treatment of a severely bleeding patient without preexisting coagulopathy with activated recombinant factor VII," Am J Med 108:421-423 (2000).
Von Depka et al., "The use of recombinant-activated factor VII in von Willebrand disease: a case series," Blood Coagul Fibrin 17:311-316 (2006).
Wajih et al., "Increased production of functional recombinant human clotting factor IX by baby hamster kidney cells engineered to overexpress VKORC1, the vitamin K 2,3-epoxide-reducing enzyme of the vitamin K cycle," J. Biol. Chem. 280(36)31603-31607 (2005).
Wagner et al., "Nucleotide sequence of the thymide kinase gene of herpes simplex virus type 1" Proc. Natl. Acad. Sci. USA 78:1441-1445 (1981).
Weiner et al., "Liposome-collagen gel matrix: a novel sustained drug delivery system." J Pharm Sci. 74(9): 922-925(1985).
Wells, "Additivity of mutational effects in proteins," Biochem. 29(37):8509-8517 (1990).
Widersten et al., "Glutathione Transferases with Novel Active Sites Isolated by Phage Display from a Library of Random Mutants" J. Mol. Biol. 250: 115-122 (1995).
Wildgoose et al., "Measurement of basal levels of factor VIIa in hemophilia A and B patients," Blood 80:25-28 (1992).
Williamson et al., "Interspecies exchange mutagenesis of the first epidermal growth factor-like domain of human factor VII," J Thromb Haemost 3:1250-1256 (2005).
Wu et al., "Characterization of a $Cys^{329}Gly$ mutation causing hereditary factor VII deficiency," Acta Haematol. 116(2):96-100 (2006).
Wulff et al., "Twenty two novel mutations of the factor VII gene in factor VII deficiency," Human Mutat. 15:489-496 (2000).
Yamamoto et al., "Identification of a functional promoter in the long terminal repeat of Rous sarcoma virus," Cell 22:787-797 (1980).
Yang et al., "Genome-wide association and linkage analyses of hemostatic factors and hematological phenotypes in the Framingham Heart Study," BMC Med Genet. 8 Suppl 1:S12 (2007).
Yuan et al.,"A hybrid sequence approach to the Paracelsus Challenge," Proteins 30:136-143 (1998).
Zaccolo et al., "An approach to random mutagenesis of DNA using mixtures of triphosphate derivatives of nucleoside analogues," J. Moi. Biol. 255:589-603 (1996).
Zhidong et al., "Severe factor VII deficiency caused by a novel point mutation (Arg353Pro) combined with a rare Cys22Arg mutation," Thromb Haemost. 98(3):687-688 (2007).
Final Office Action dated Feb. 10, 2021, for U.S. Appl. No. 16/179,642, filed Nov. 2, 2018, 13 pages.
Jin et al., "Creation of a mouse expressing defective human factor IX," Blood 104(6): 1733-1739 (2004).
MacDonald, "Expression of the pancreatic elastase I gene in transgenic mice," Hepatology 7(1):42S-51S(1987).
ClinicalTrials.gov (2020). "Study of coagulation factor VIIa Marzeptacog alfa (activated) in subjects with Hemophilia A or B," Clinical Trials Identifier No. NCT04489537, with Jul. 24, 2020 and Jul. 27, 2020 comparison included, located at https://clinicaltrials.gov/ct2/show/record/NCT04489537?view=record, 16 total pages.
Del Greco, F. et al. (2019). "Fast Onset of Action of Subcutaneously Administered Marzeptacog Alfa (Activated) Supports on-Demand Treatment in Hemophilia a Mice," Blood 134 (Supplement 1):2420, 2 total pages.
Non-Final Office Action dated Jul. 20, 2020, for U.S. Appl. No. 16/179,642, filed Nov. 2, 2018, 13 pages.
Notice of Allowance dated Aug. 18, 2021, for U.S. Appl. No. 16/179,642, filed Nov. 2, 2018, 9 pages.
Tiede, A. et al. (2011). "Safety and pharmacokinetics of subcutaneously administered recombinant activated factor VII (rFVIIa)," J. of Thrombosis and Haemostasis 9:1191-1199.

\* cited by examiner

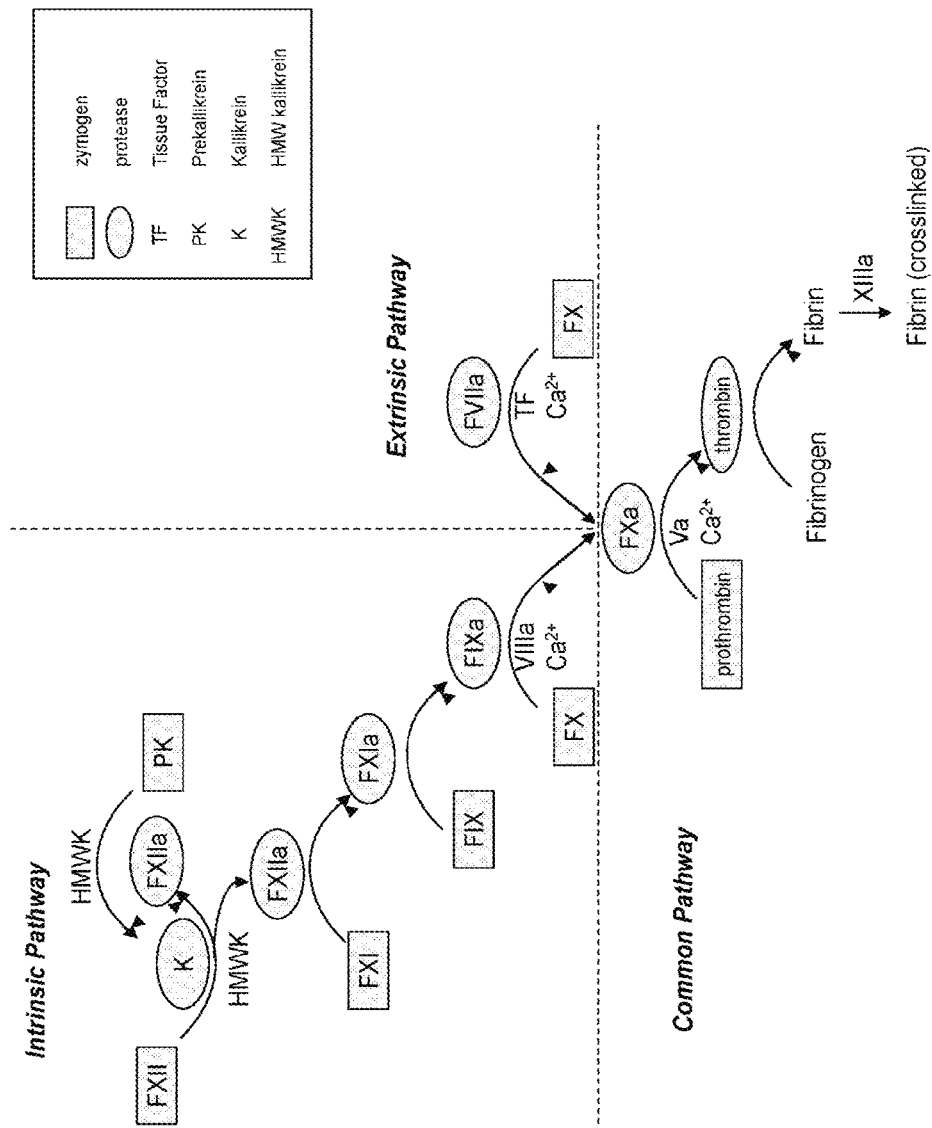
FIG. 1. Coagulation cascade

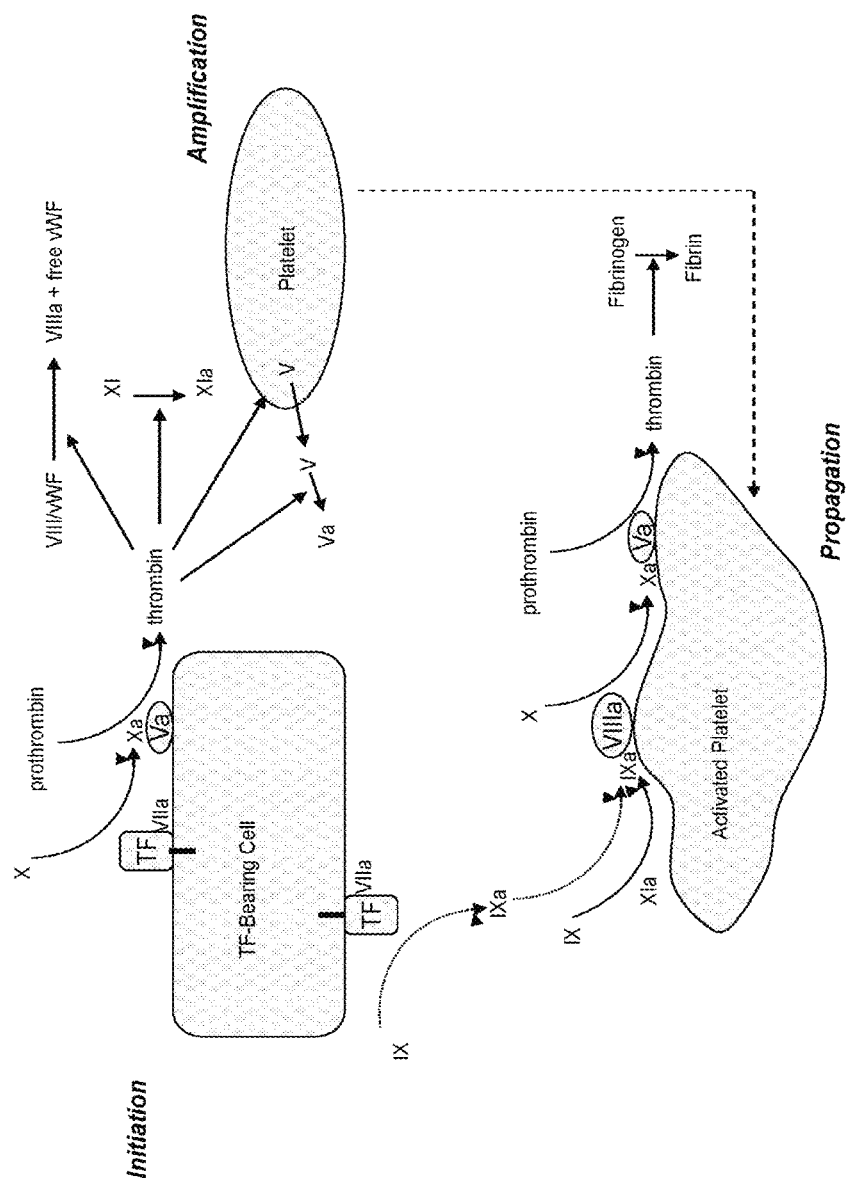
FIG. 2. Cell-based model of coagulation

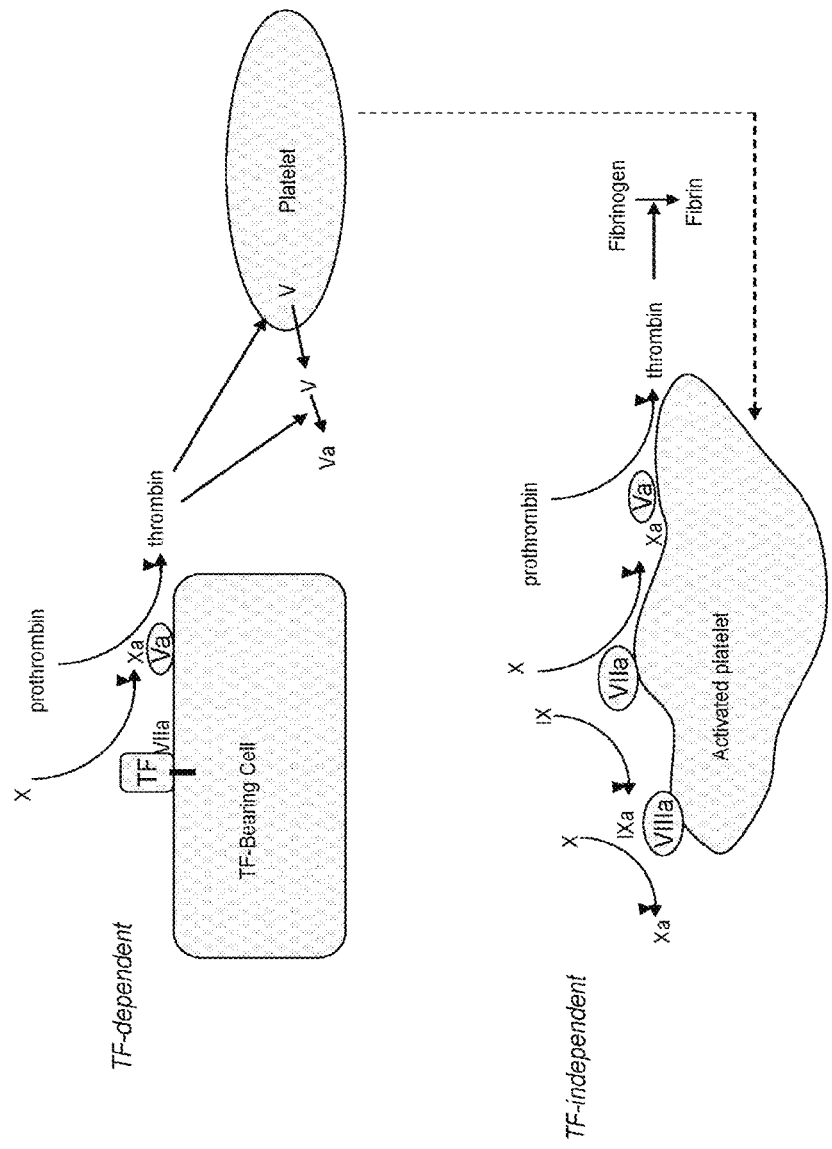
FIG. 3. TF-dependent and -independent FVII initiation of thrombin production

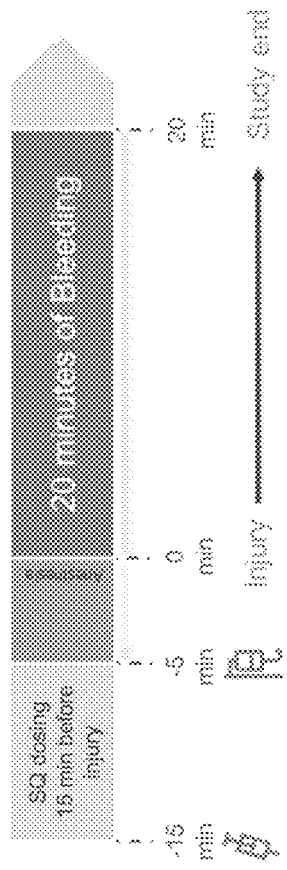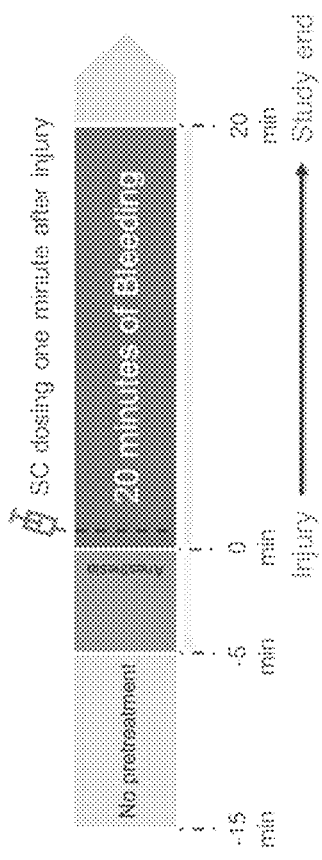
FIG. 4A
FIG. 4B

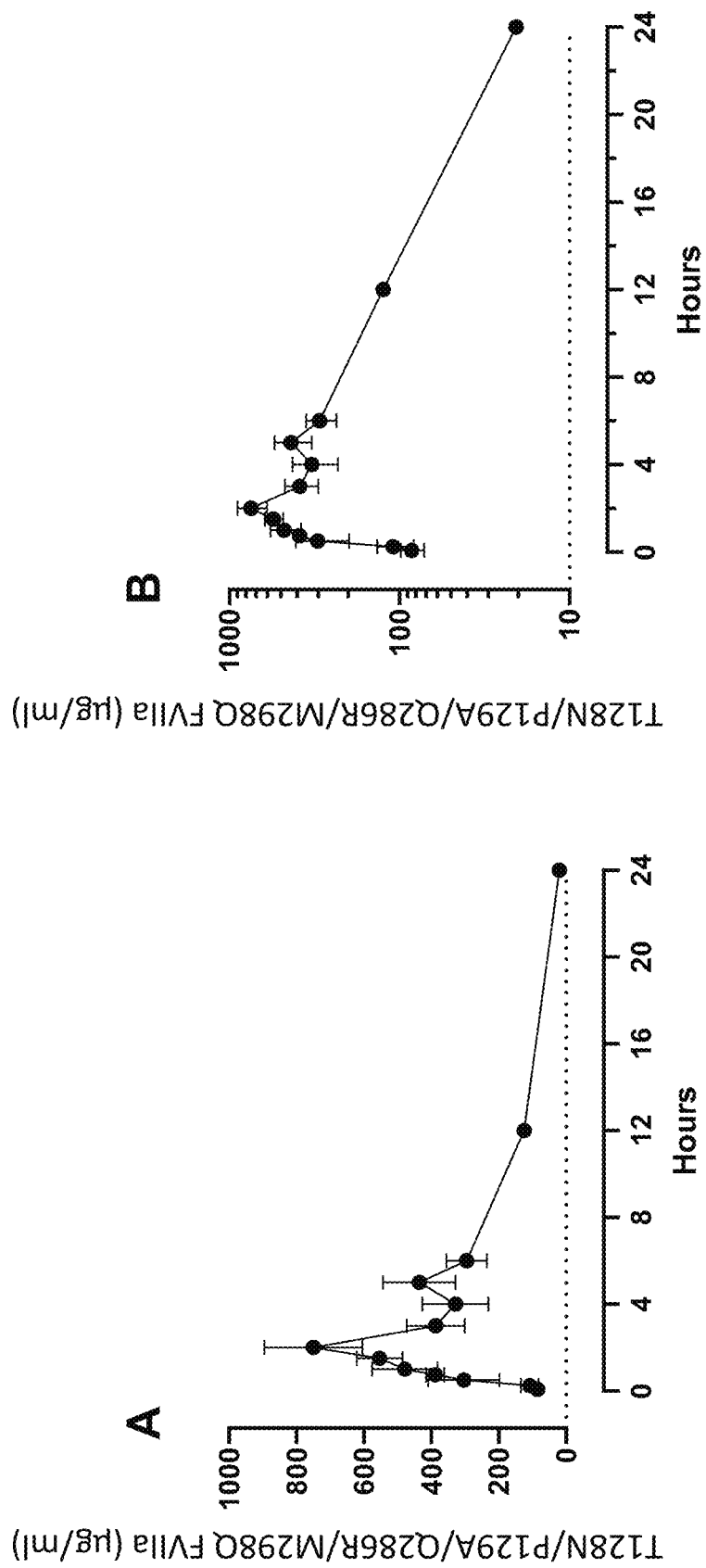
FIG. 10. Plasma concentrations of T128N/P129A/Q286R/M298Q FVIIa following SQ injection to mice. A) Arithmetic, B) Logarithmic. Mean ± SD.

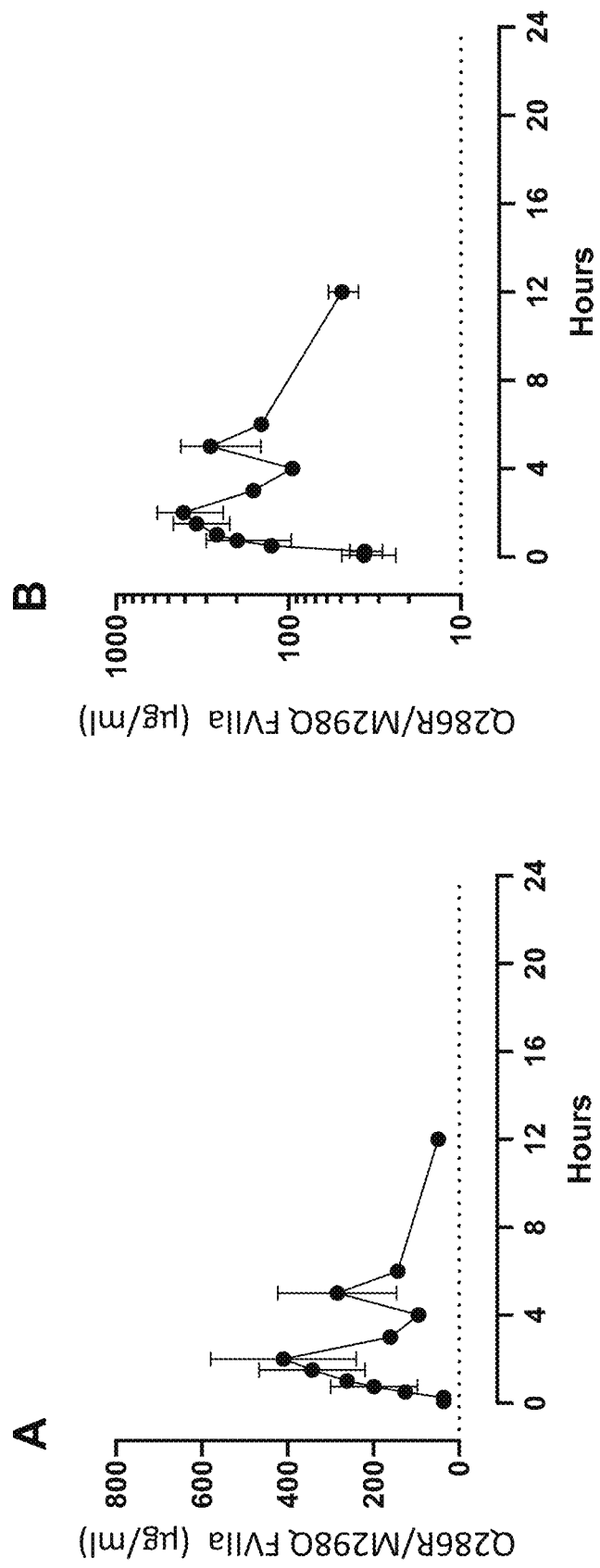
FIG. 11. Plasma concentrations of Q286R/M298Q FVIIa following SQ injection to mice. A) Arithmetic, B) Logarithmic. Mean ± SD.

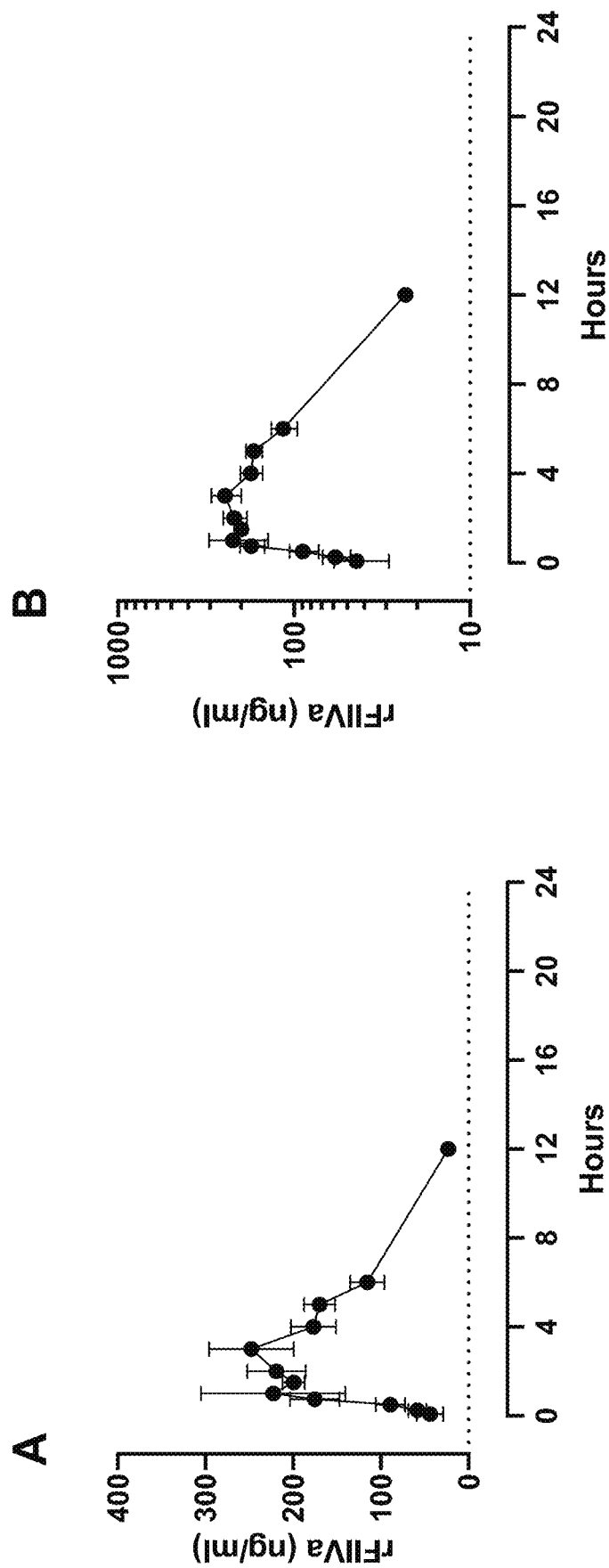
FIG. 12. Plasma concentrations of rFVIIa following SQ injection to mice. A) Arithmetic, B) Logarithmic. Mean ± SD.

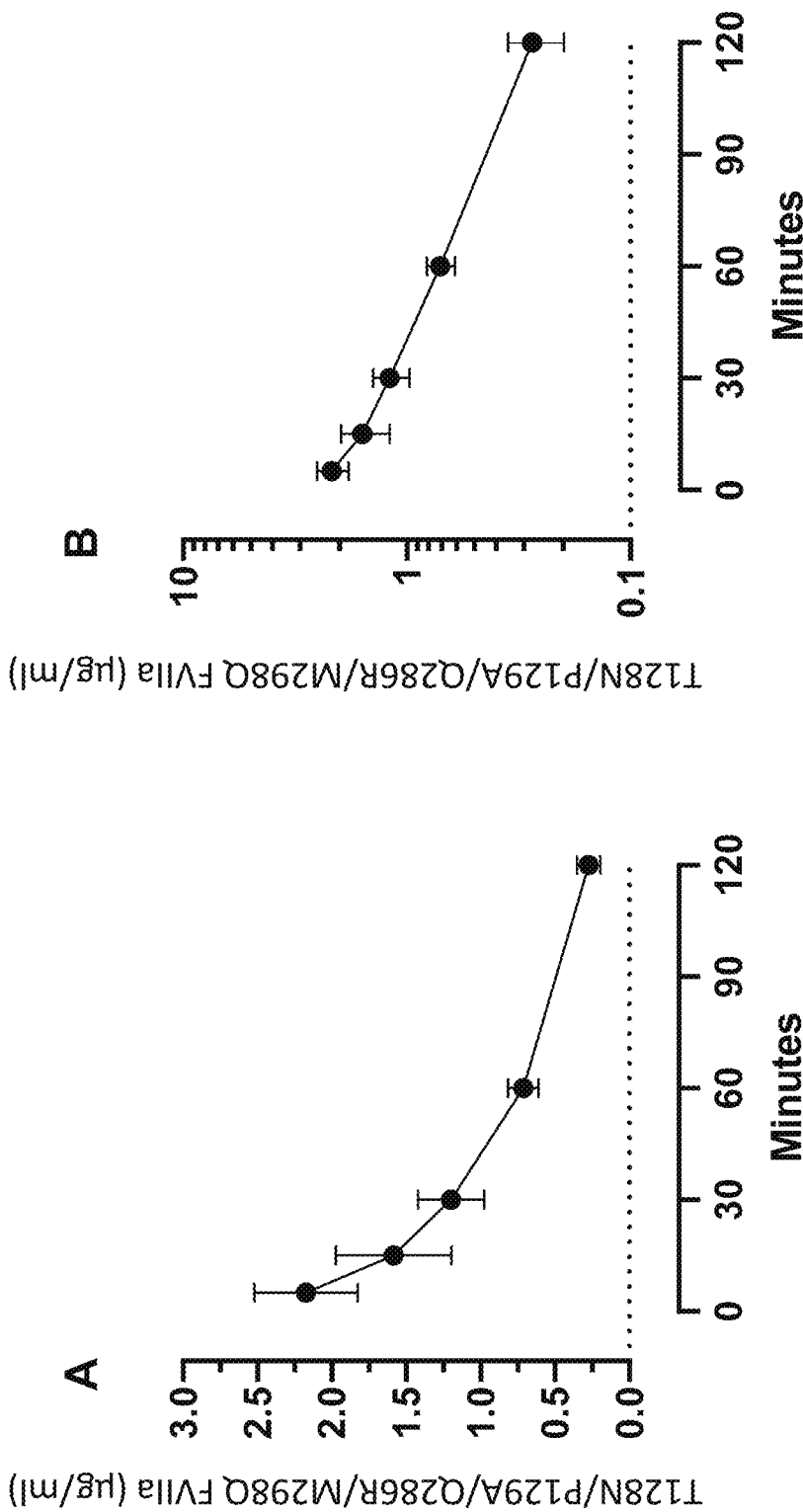
FIG. 13. Plasma concentrations of T128N/P129A/Q286R/M298Q FVIIa following IV bolus injection to mice. A) Arithmetic, B) Logarithmic. Mean ± SD.

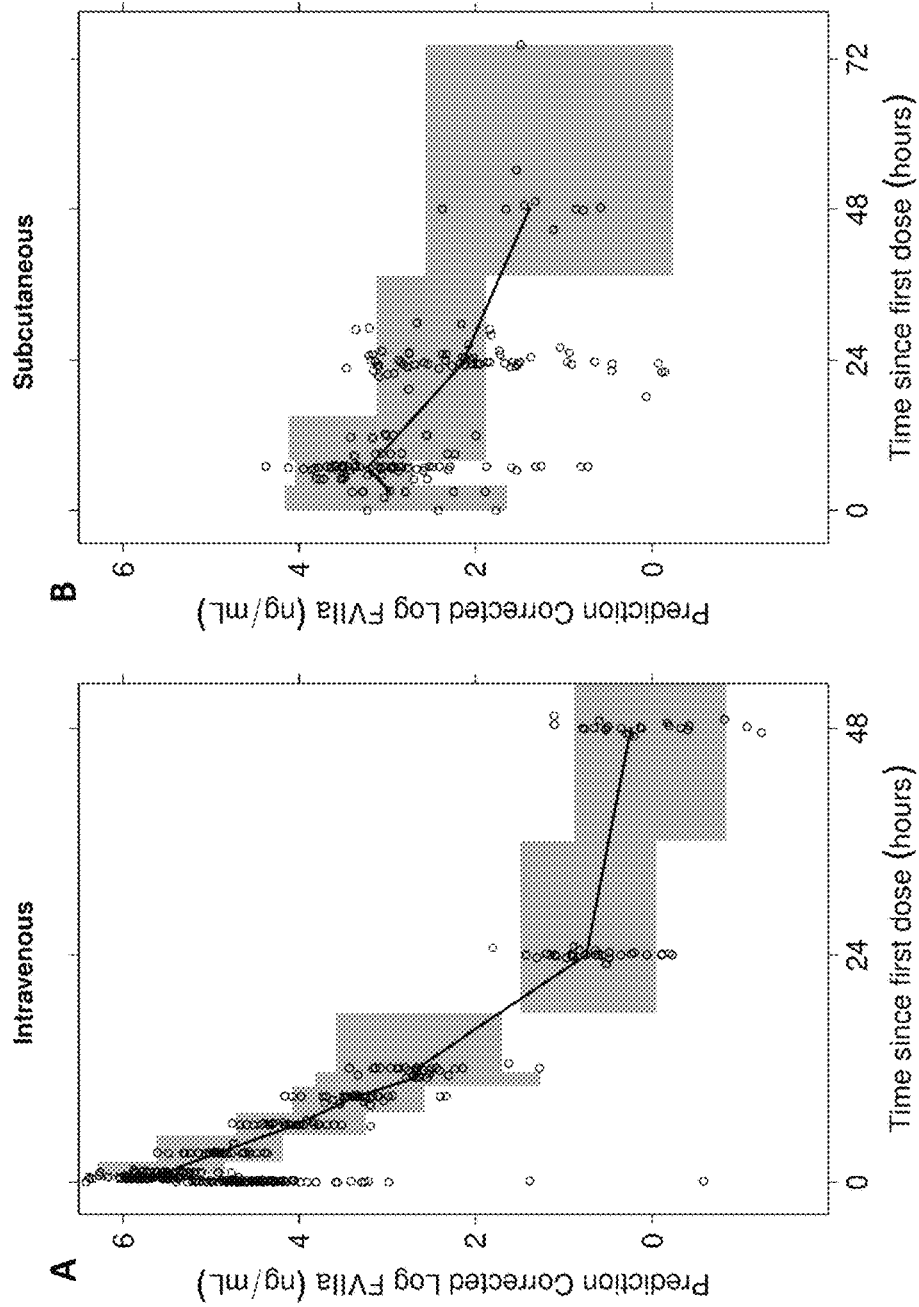
FIG. 14. Visual predictive check for the T128N/P129A/Q286R/M298Q FVIIa concentrations across all dose groups.

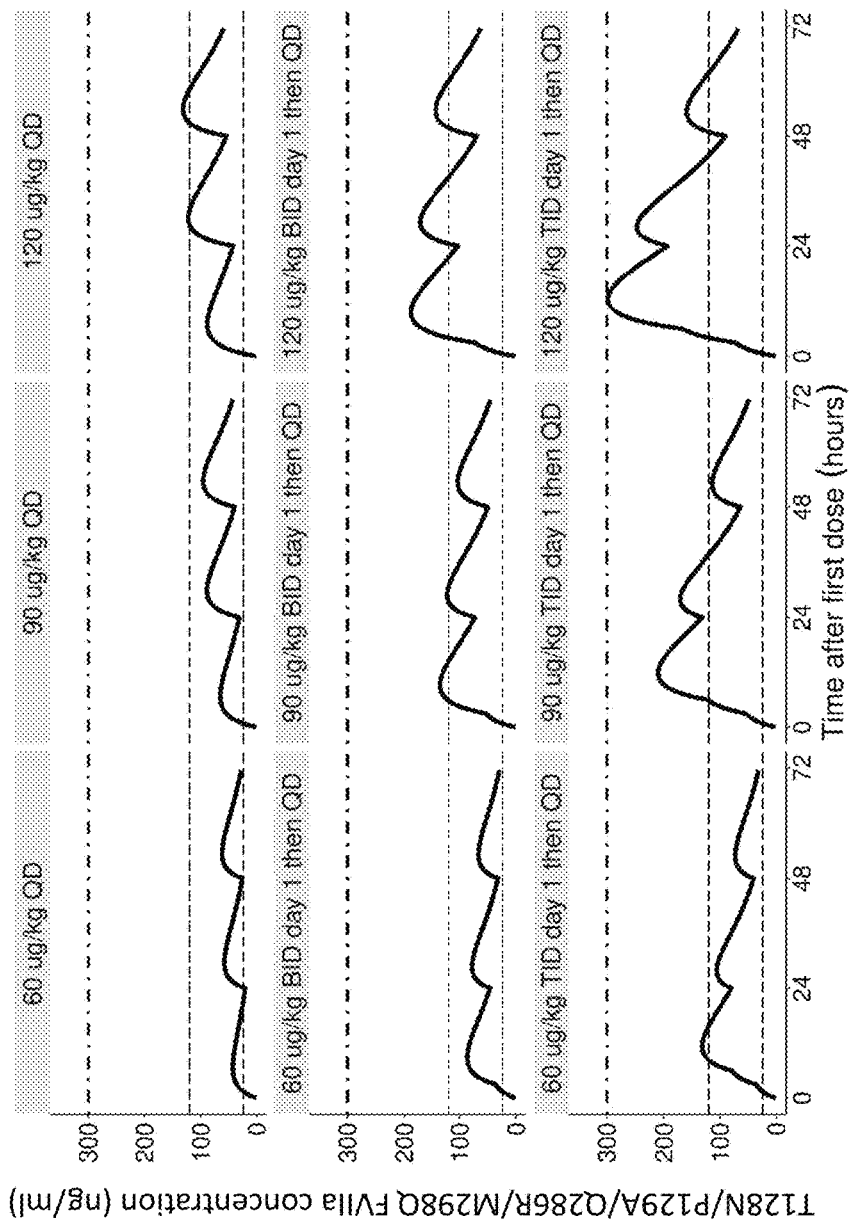
FIG. 15A. Clinical trial simulations in a 70 kg adult using 3 different T128N/P129A/Q286R/M298Q FVIIa treatment regimens.

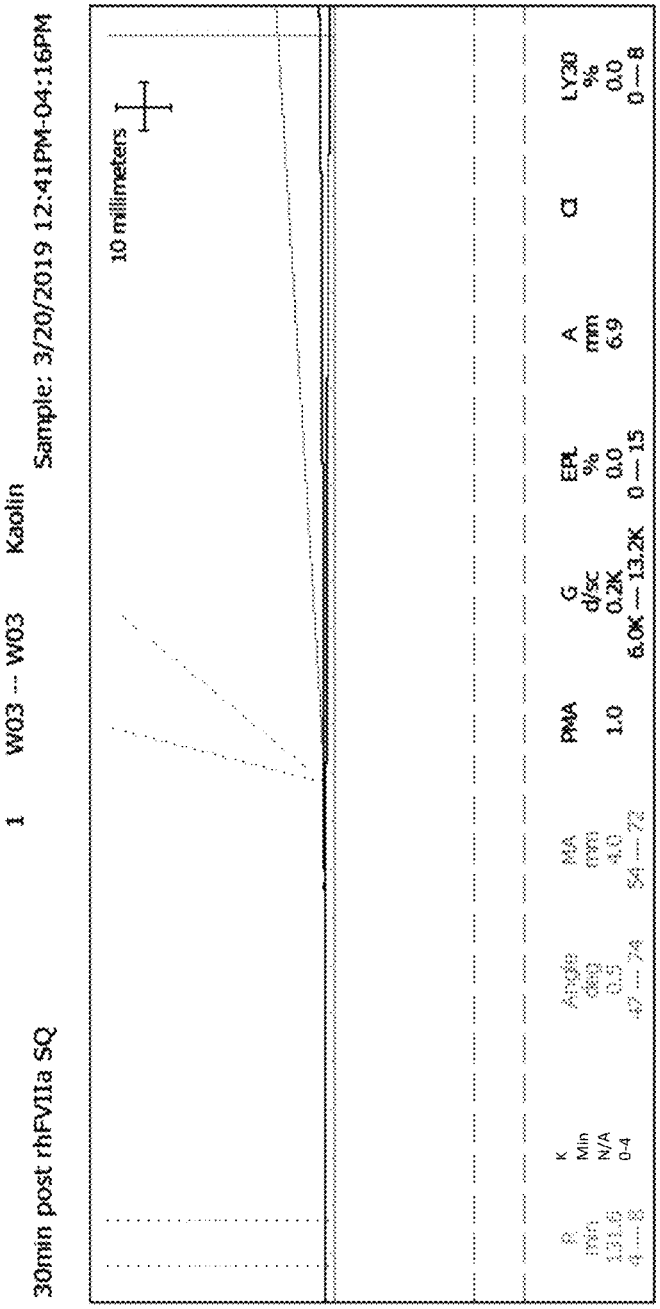
FIG. 20A. W03-TEG Trace 30 Minutes Post-Subcutaneous Recombinant Human Factor VIIa

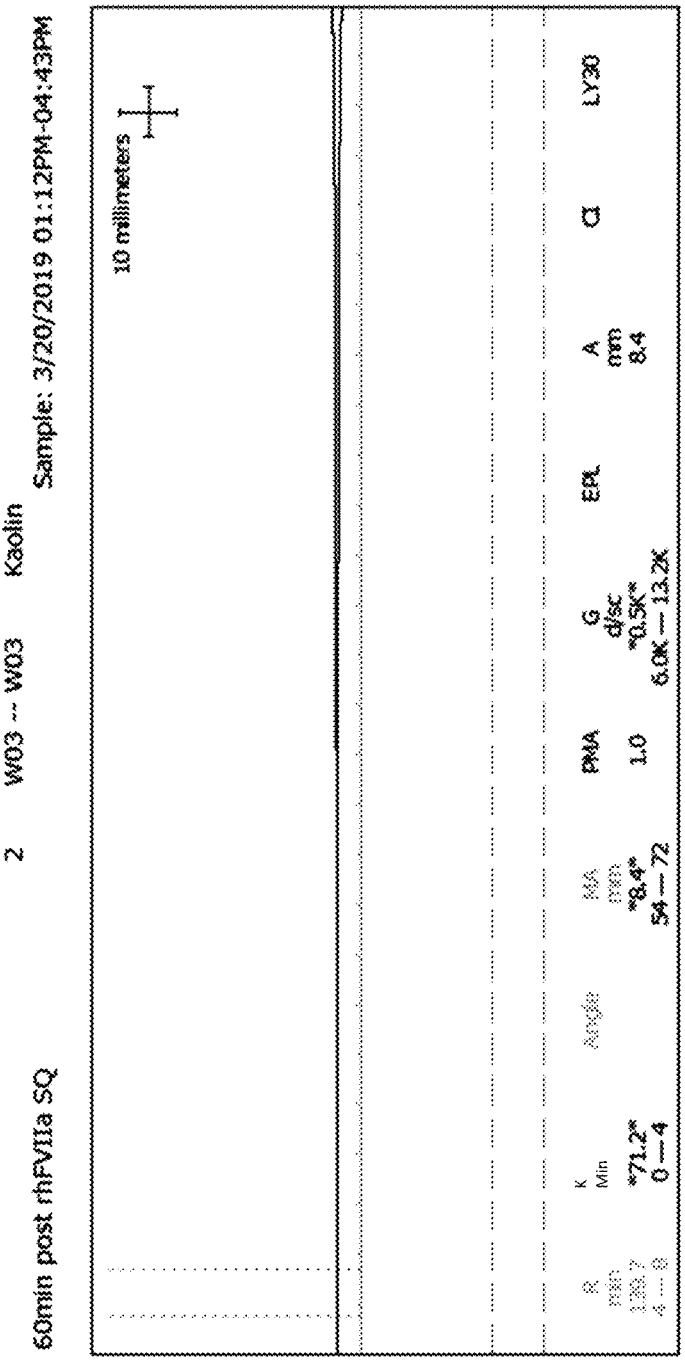
FIG. 20B. W03-TEG Trace 60 Minutes Post-Subcutaneous Recombinant Human Factor VIIa

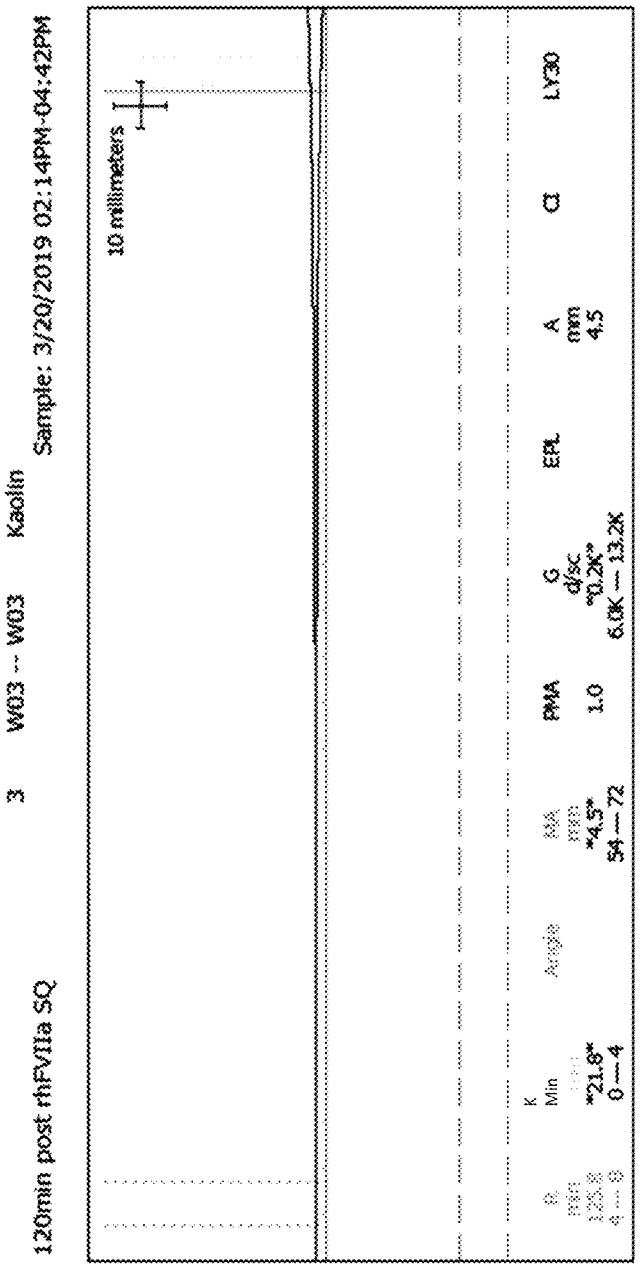
FIG. 20C. W03-TEG Trace 120 Minutes Post-Subcutaneous Recombinant Human Factor VIIa

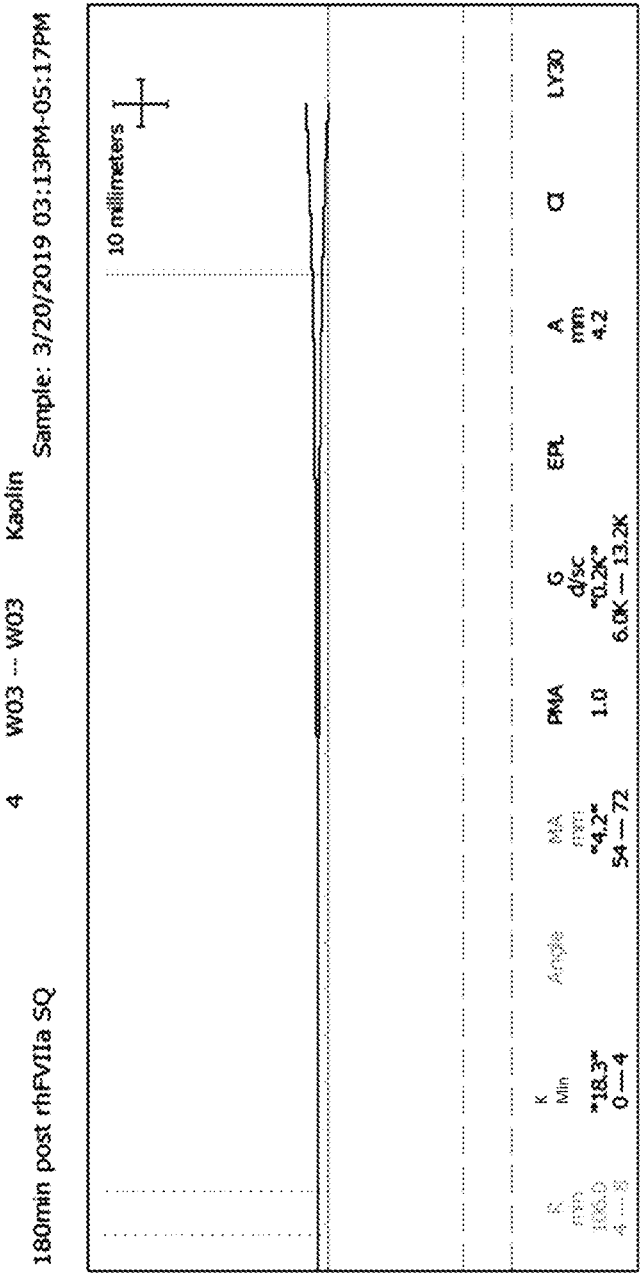
FIG. 20D. W03-TEG Trace 180 Minutes Post-Subcutaneous Recombinant Human Factor VIIa

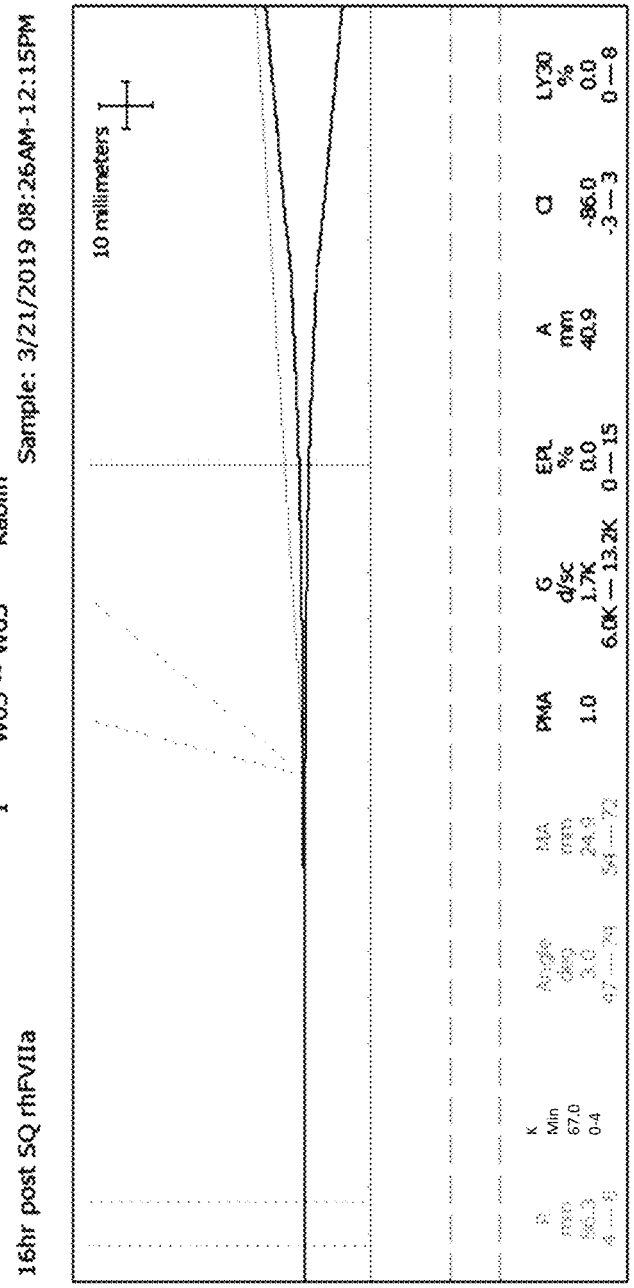
FIG. 20E. W03-TEG Trace 16 Hours Post-Subcutaneous Recombinant Human Factor VIIa

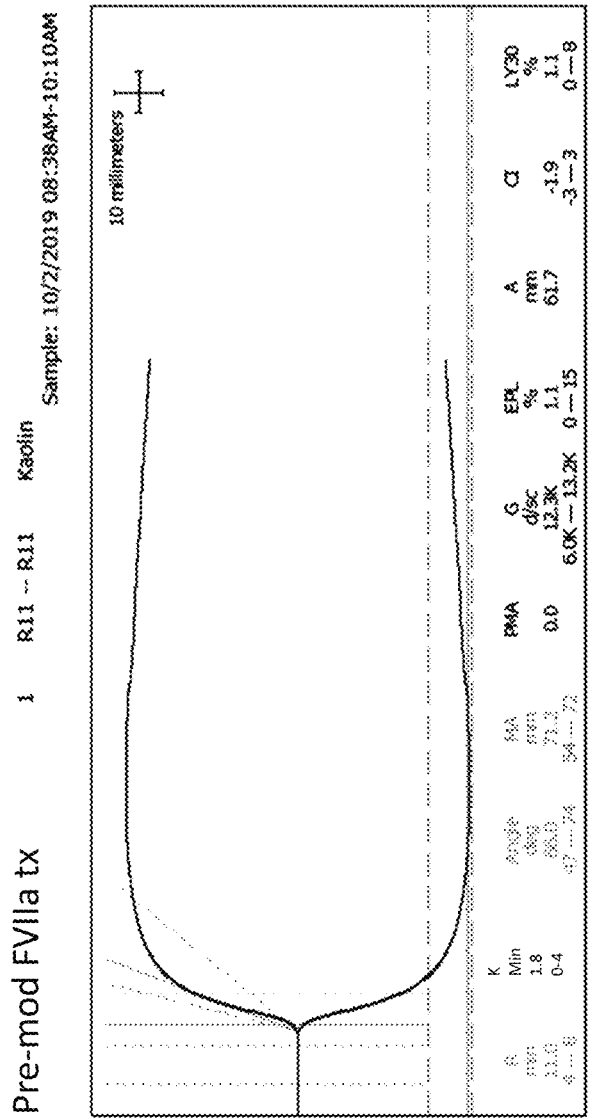
FIG. 21A. R11-TEG Trace Pre Subcutaneous Mod FVIIa Treatment

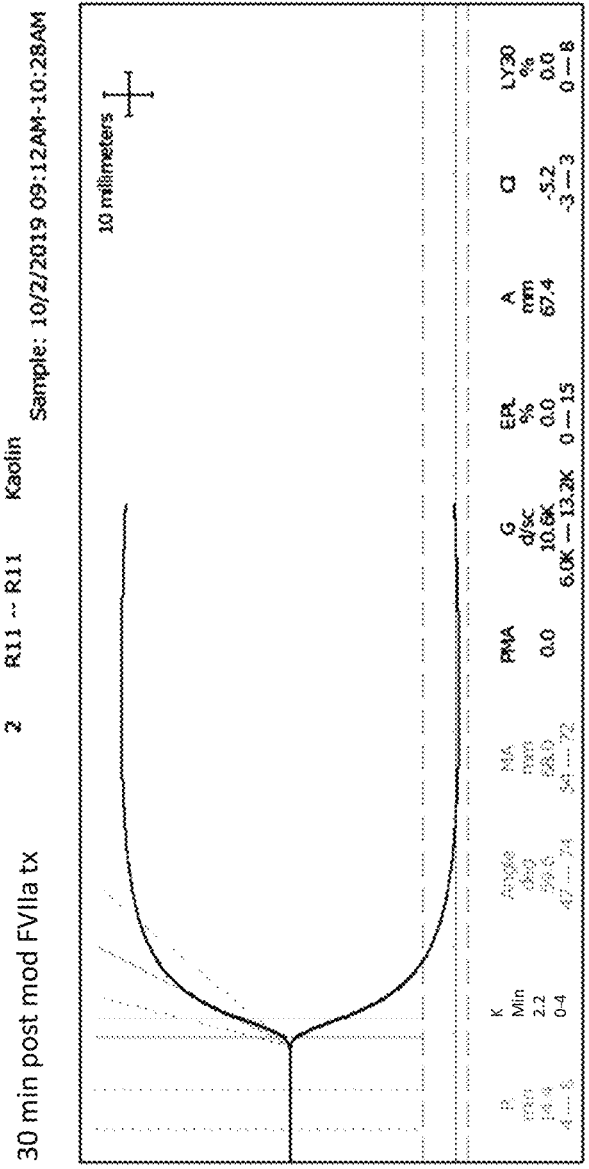
FIG. 21B. R11-TEG Trace 30 Minutes Post-Subcutaneous Mod FVIIa Treatment

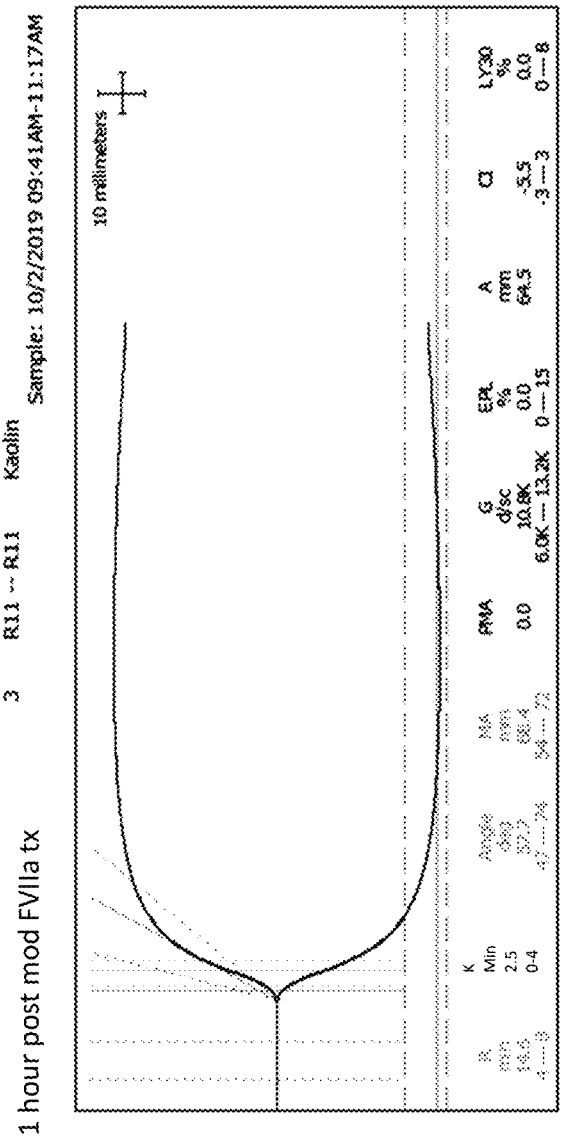
FIG. 21C. R11-TEG Trace 1 Hour Post-Subcutaneous Mod FVIIa Treatment

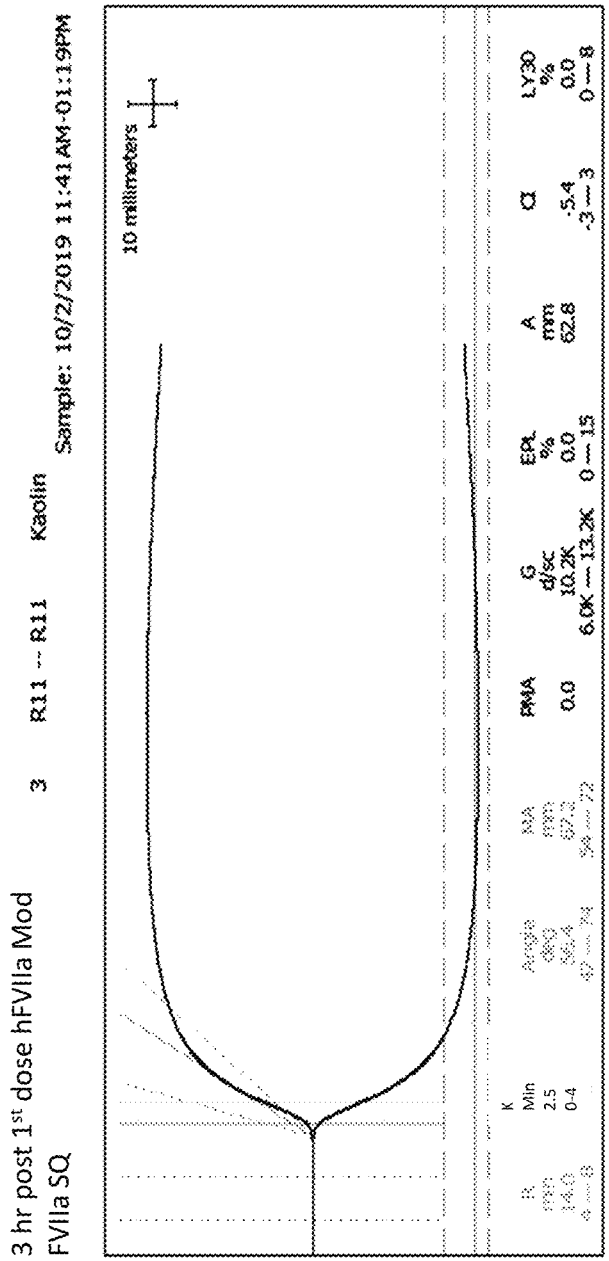
FIG. 21D. R11-TEG Trace 3 Hours Post-Subcutaneous Mod FVIIa Dose 1

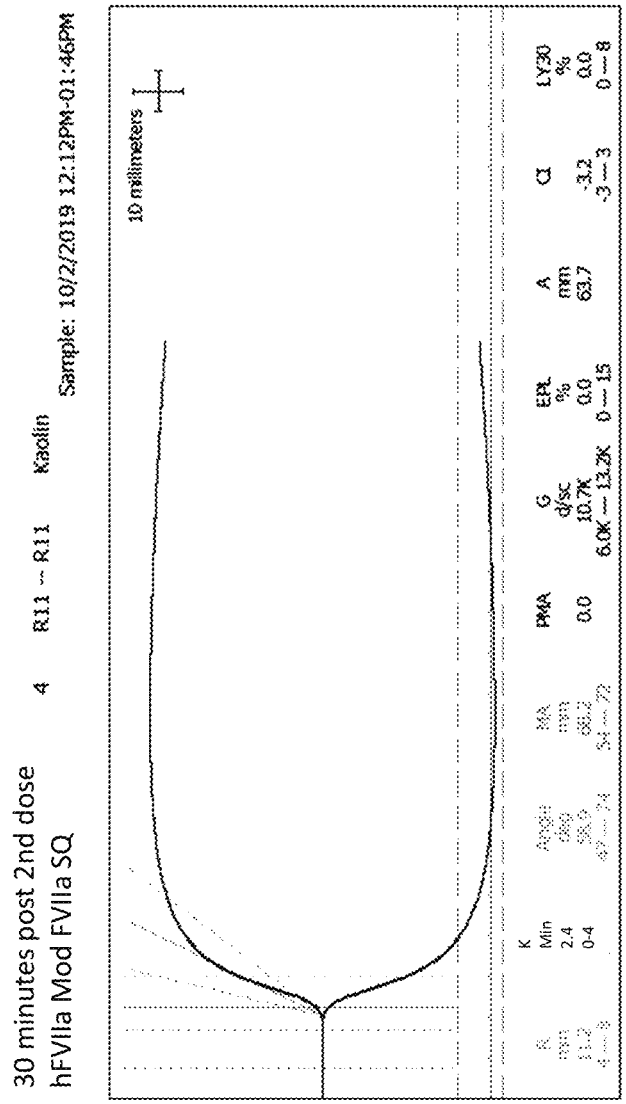
FIG. 21E. R11-TEG Trace 30 Minutes Post-Subcutaneous Mod FVIIa Dose 2

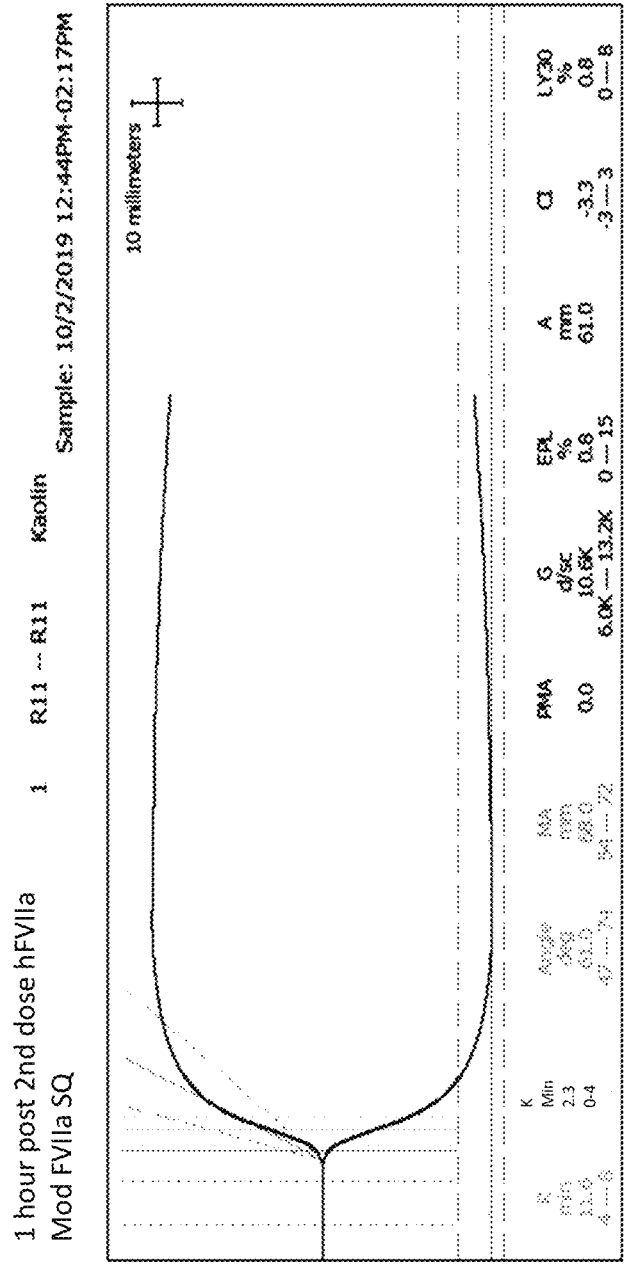
FIG. 21F. R11-TEG Trace 1 Hour Post-Subcutaneous Mod FVIIa Dose 2

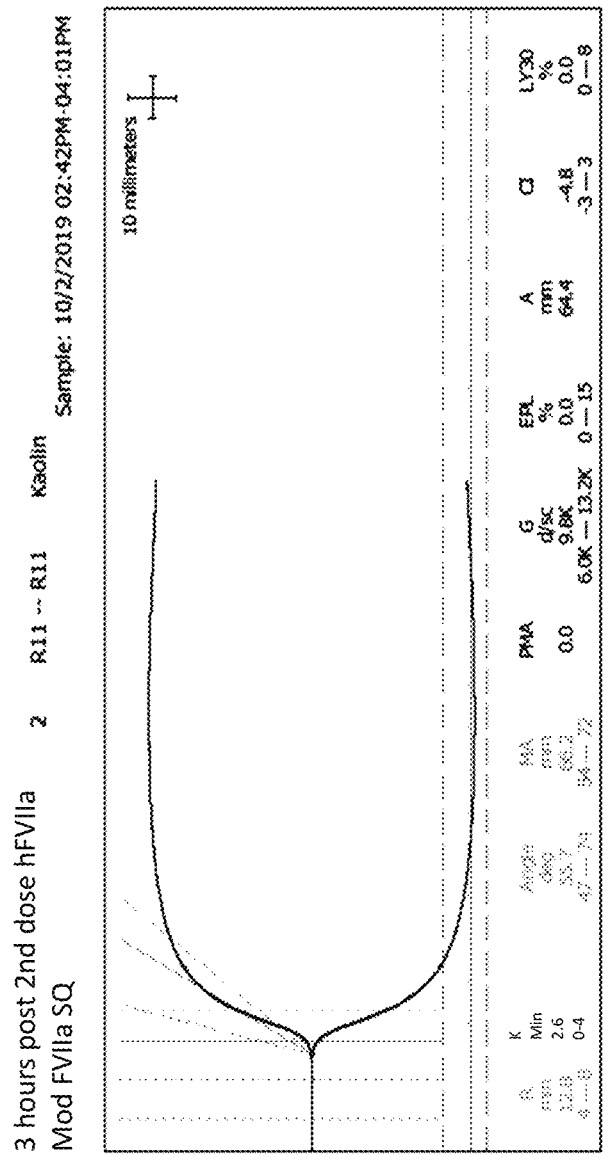
FIG. 21G. R11-TEG Trace 3 Hours Post-Subcutaneous Mod FVIIa Dose 2

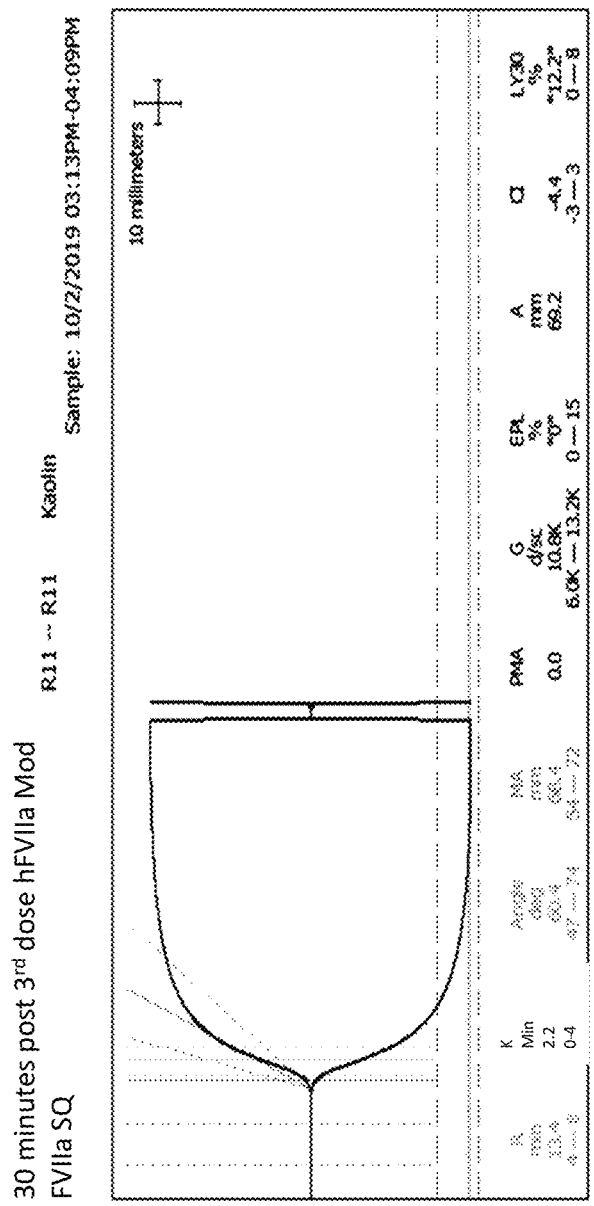
FIG. 21H. R11-TEG Trace 30 Minutes Post-Subcutaneous Mod FVIIa Dose 3

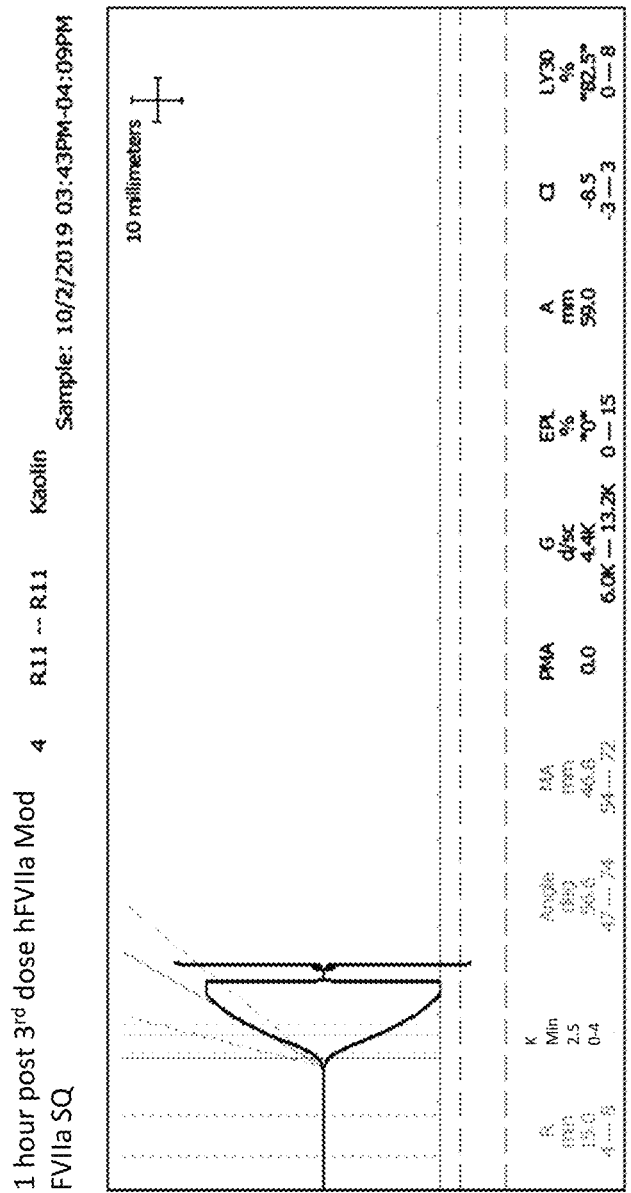
FIG. 21I. R11-TEG Trace 1 Hour Post-Subcutaneous Mod FVIIa Dose 3

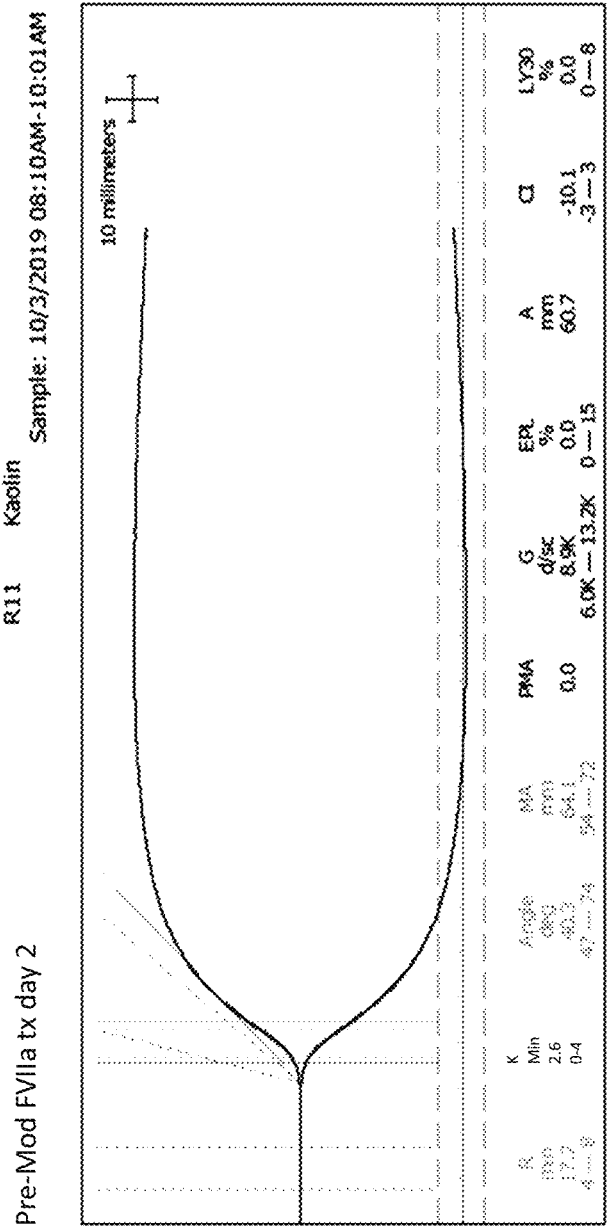
FIG. 21J. R11-TEG Trace Pre-Subcutaneous Mod FVIIa Treatment Day 2

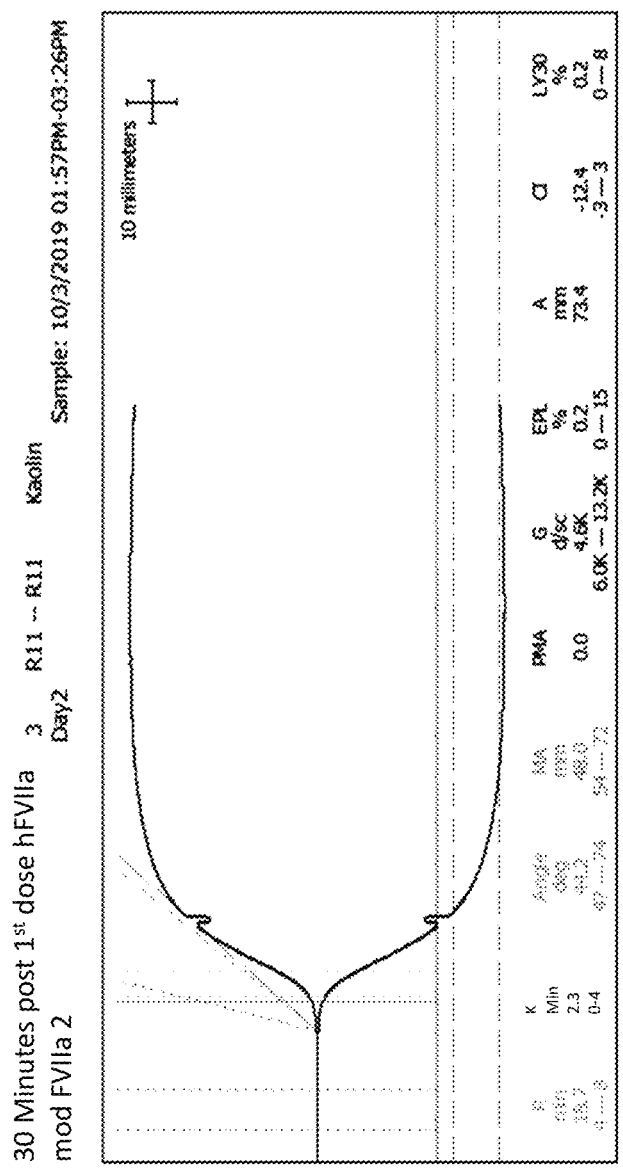
FIG. 21K. R11-TEG Trace 30 Minutes Post-Intravenous Mod FVIIa Treatment Day 2

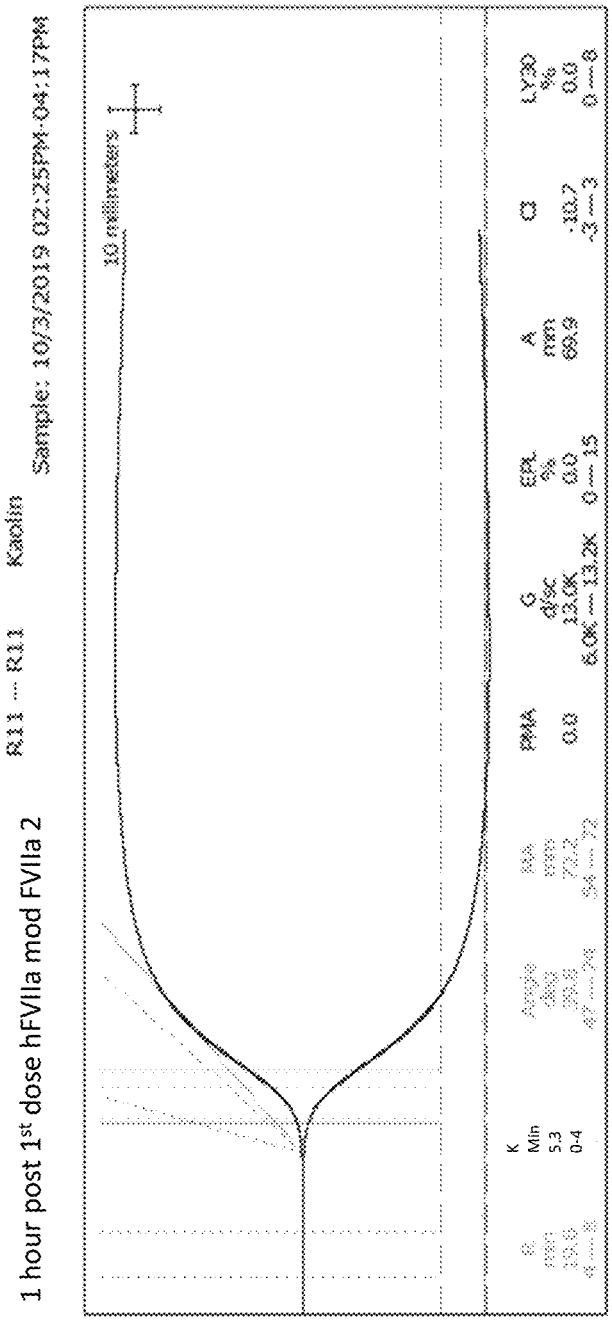
FIG. 21L. R11-TEG Trace 1 Hour Post-Intravenous Mod FVIIa Treatment Day 2

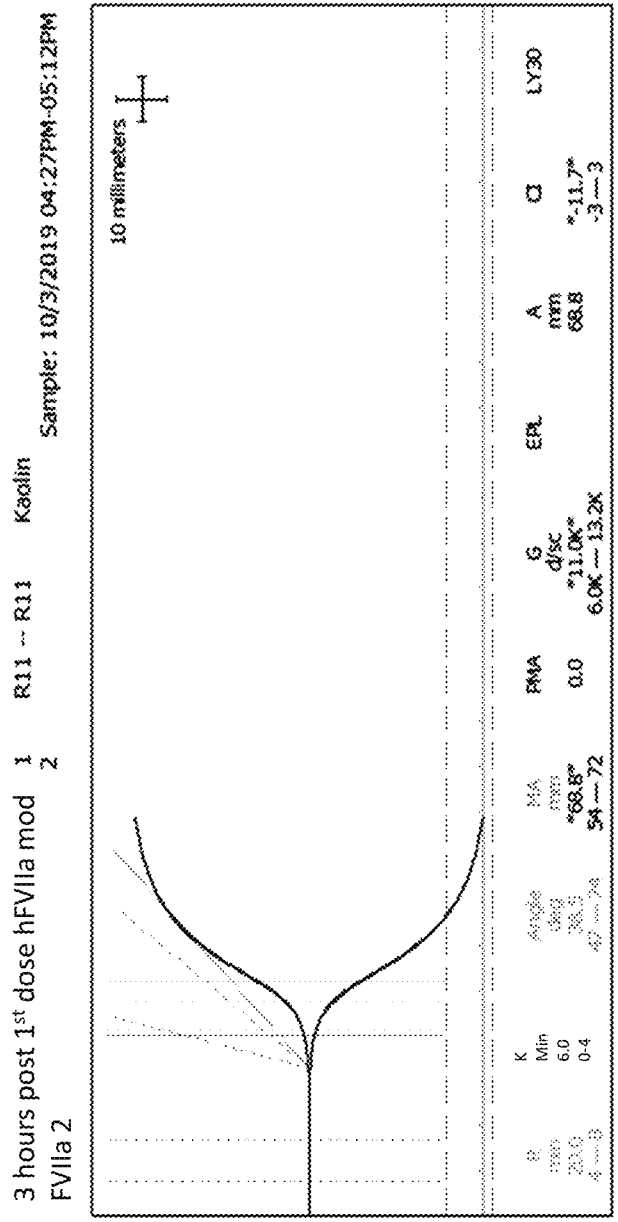
FIG. 21M. R11-TEG Trace 3 Hours Post-Intravenous Mod FVIIa Treatment Day 2

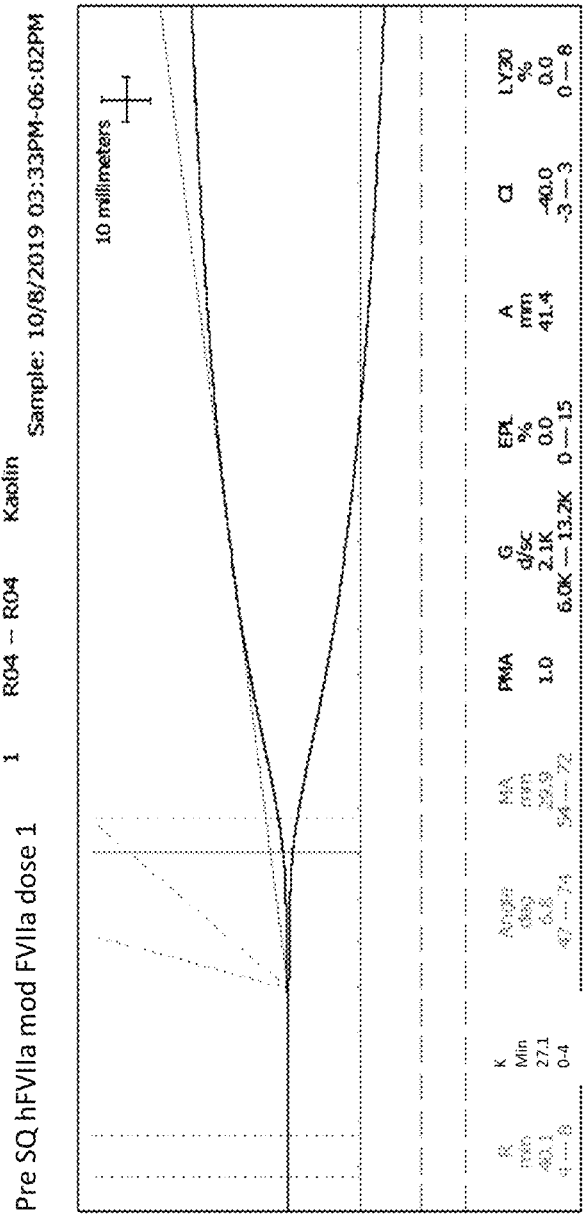
FIG. 22A. R04-TEG Trace Pre-Subcutaneous Mod FVIIa Treatment Dose 1

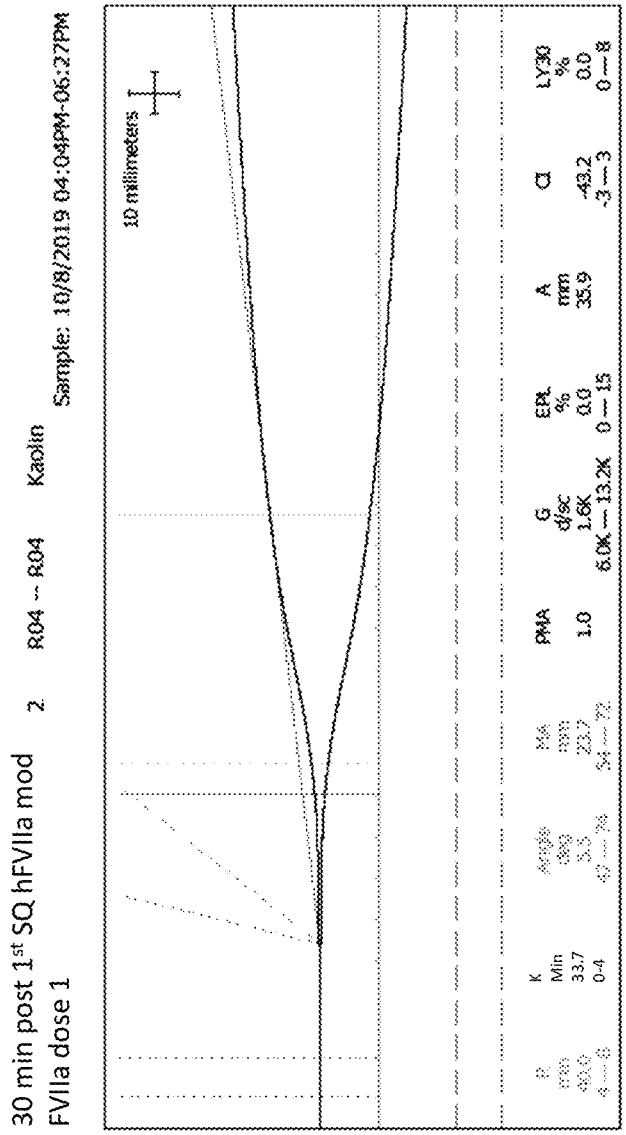
FIG. 22B. R01-TEG Trace 30 Minutes Post-Subcutaneous Mod FVIIa Treatment Dose 1

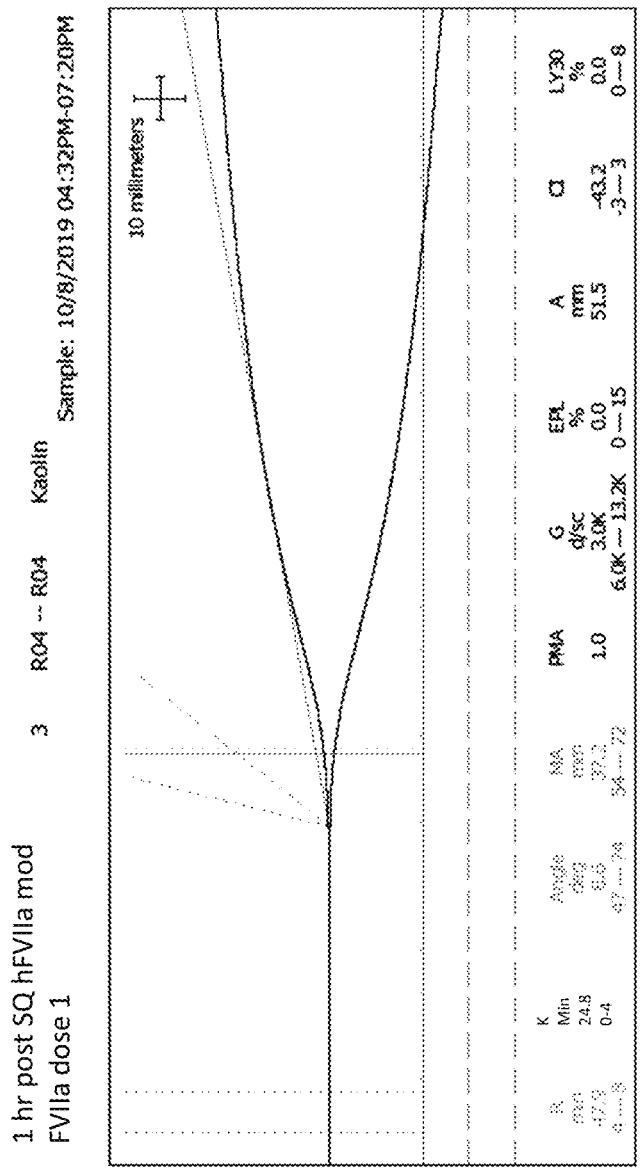
FIG. 22C. R04-TEG Trace Pre-Subcutaneous Mod FVIIa Treatment Dose 1

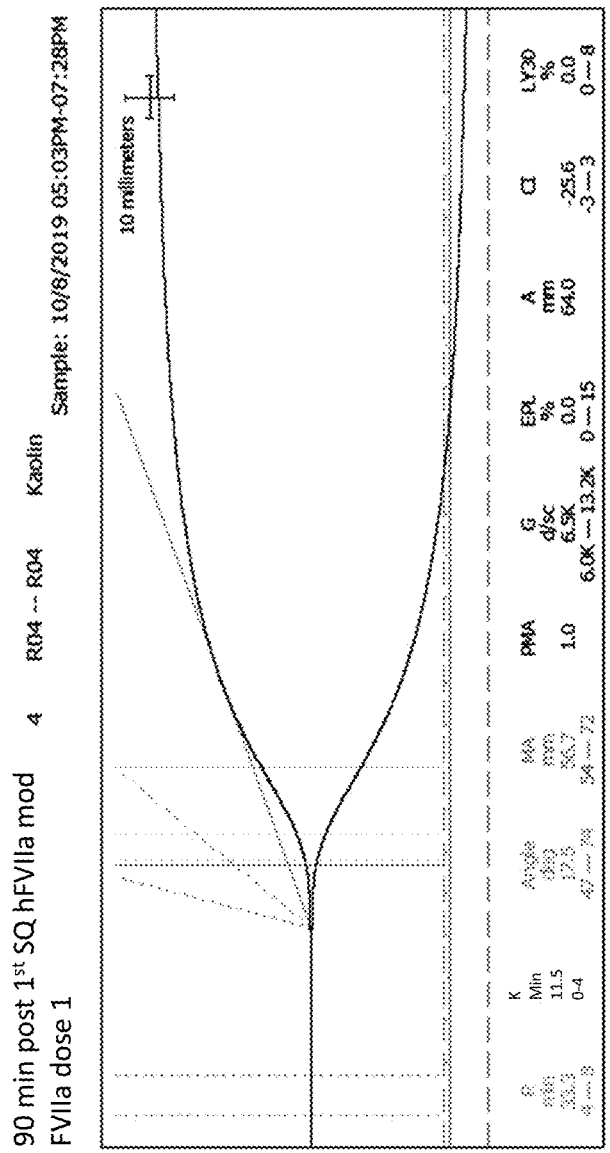
FIG. 22D. R01-TEG Trace 90 Minutes Post-Subcutaneous Mod FVIIa Treatment Dose 1

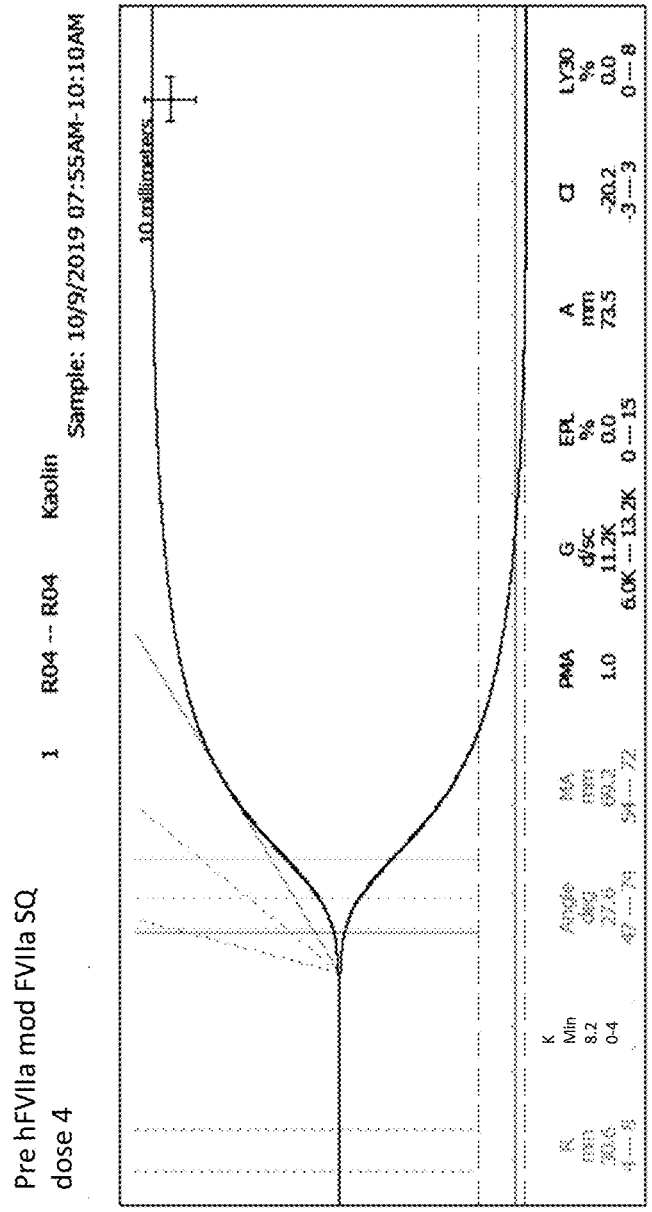
FIG. 22E. R04-TEG Trace Pre-Subcutaneous Mod FVIIa Treatment Dose 4

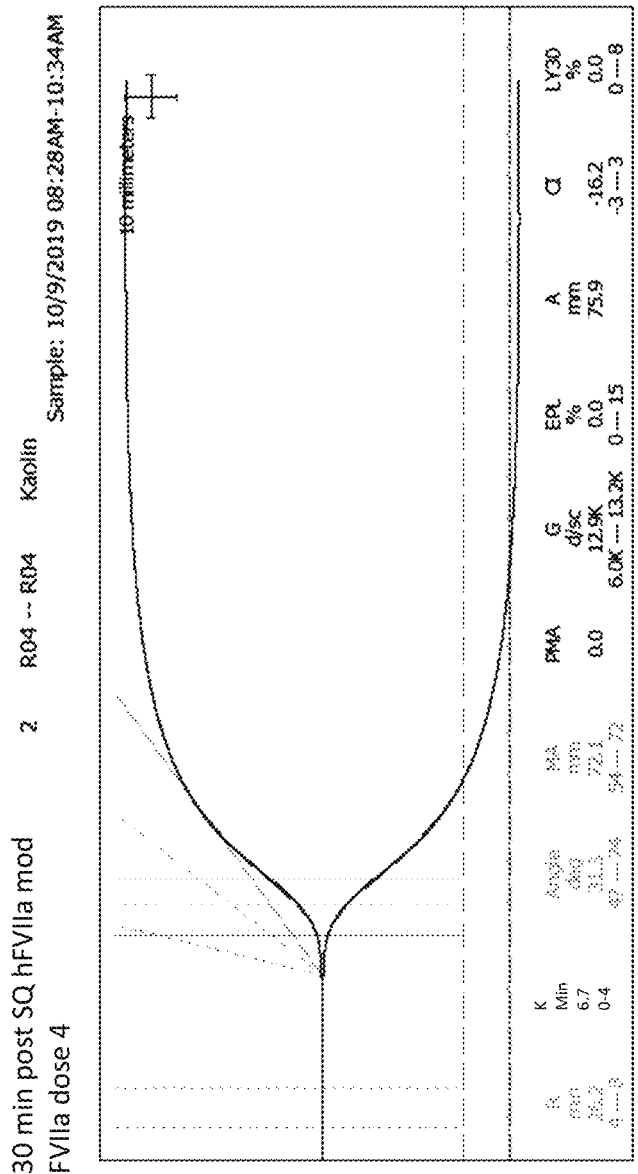
FIG. 22F. R01-TEG Trace 30 Minutes Post-Subcutaneous Mod FVIIa Treatment Dose 4

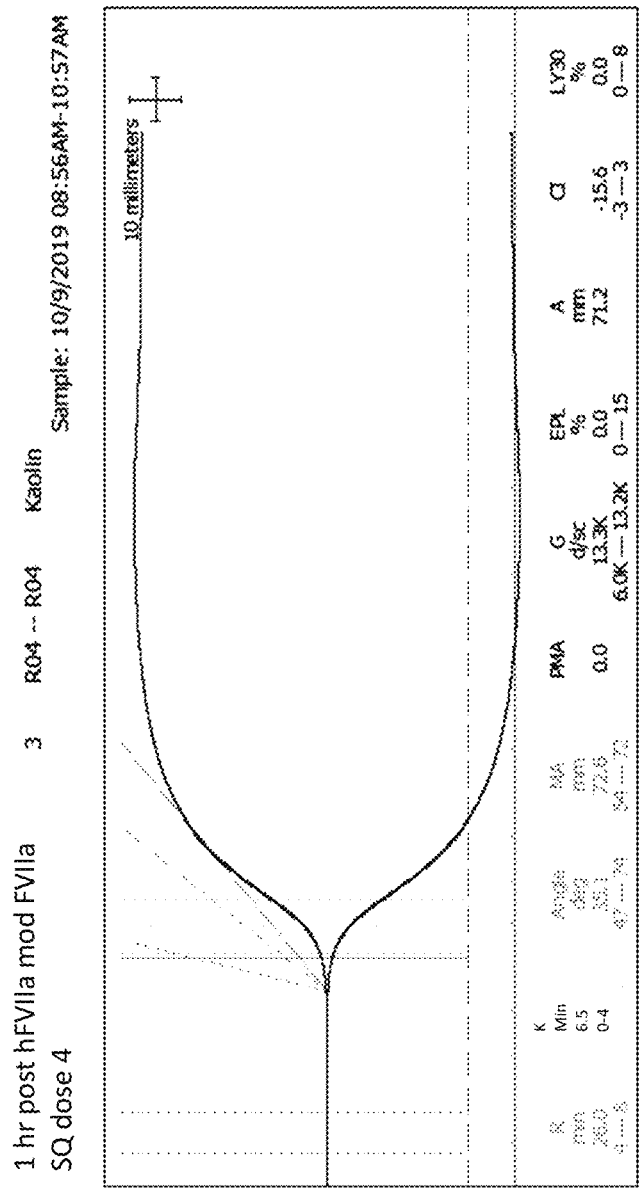
FIG. 22G. R04-TEG Trace 1 Hour Post-Subcutaneous Mod FVIIa Treatment Dose 4

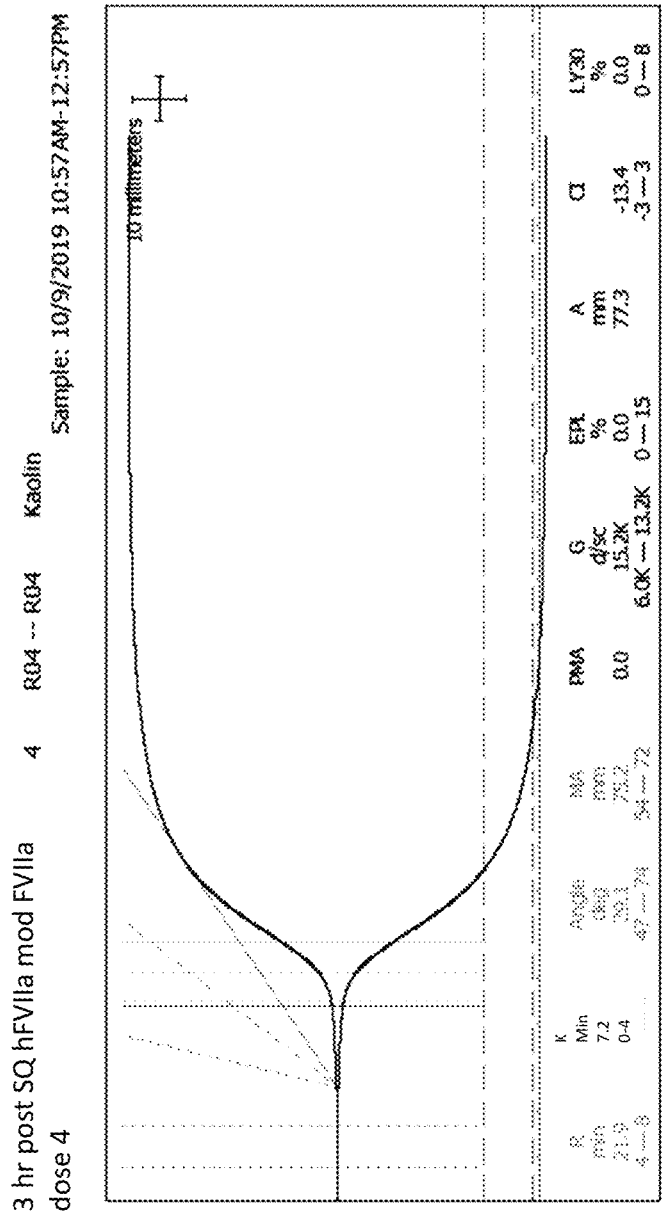
FIG. 22H. R01-TEG Trace 3 Hours Post-Subcutaneous Mod FVIIa Treatment Dose 4

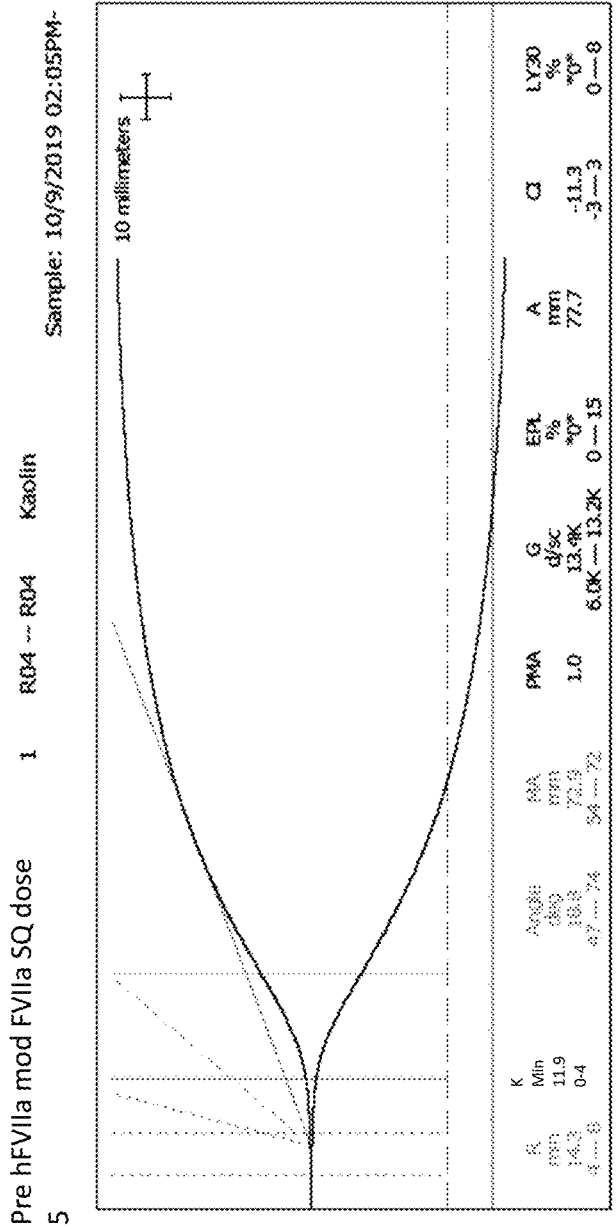
FIG. 22I. R04-TEG Trace Pre-Subcutaneous Mod FVIIa Treatment Dose 5

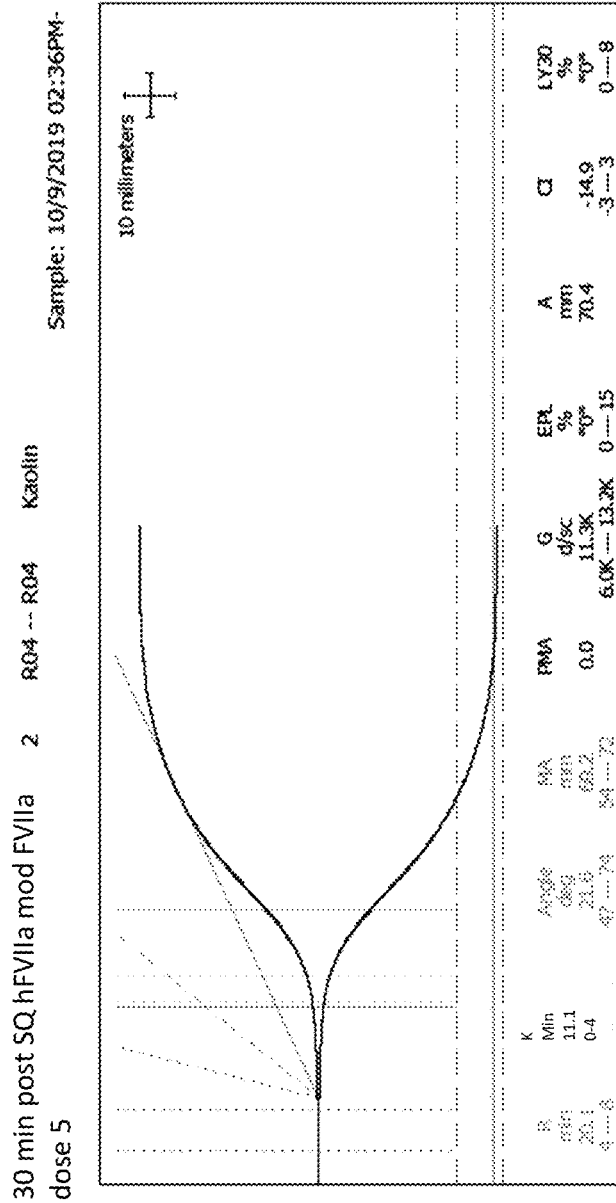
FIG. 22J. R01-TEG Trace 30 Minutes Post-Subcutaneous Mod FVIIa Treatment Dose 5

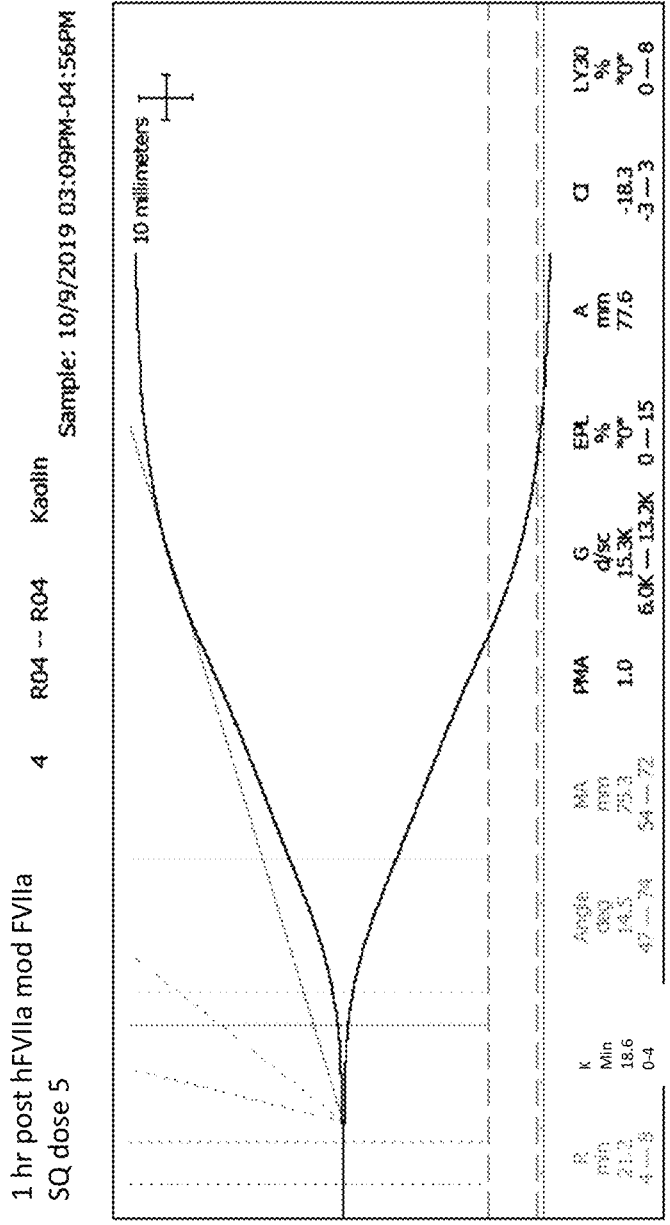
FIG. 22K. R04-TEG Trace 1 Hour Post-Subcutaneous Mod FVIIa Treatment Dose 5

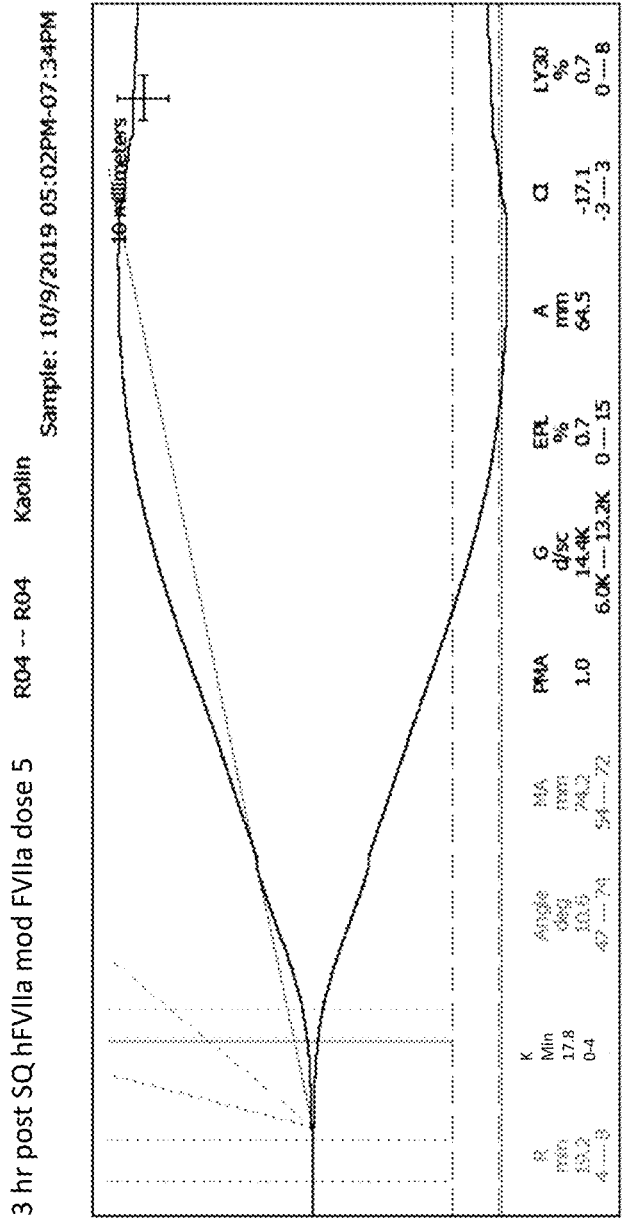
FIG. 22L. R01-TEG Trace 3 Hours Post-Subcutaneous Mod FVIIa Treatment Dose 5

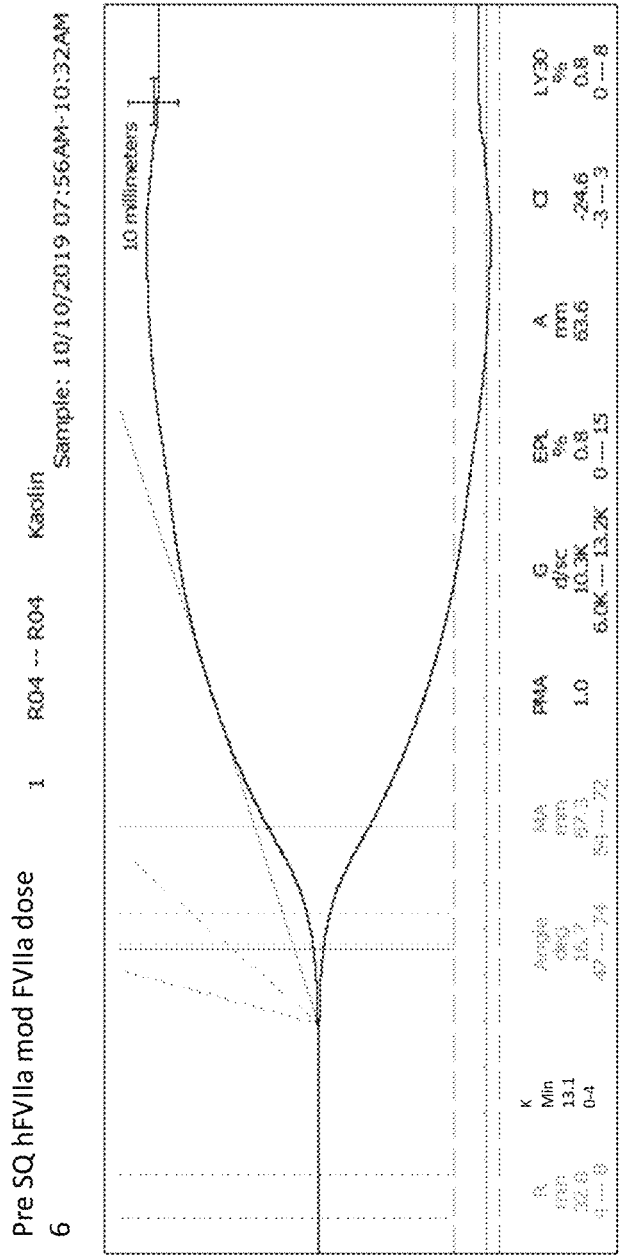
FIG. 22M. RO4-TEG Trace Pre-Subcutaneous Mod FVIIa Treatment Dose 6

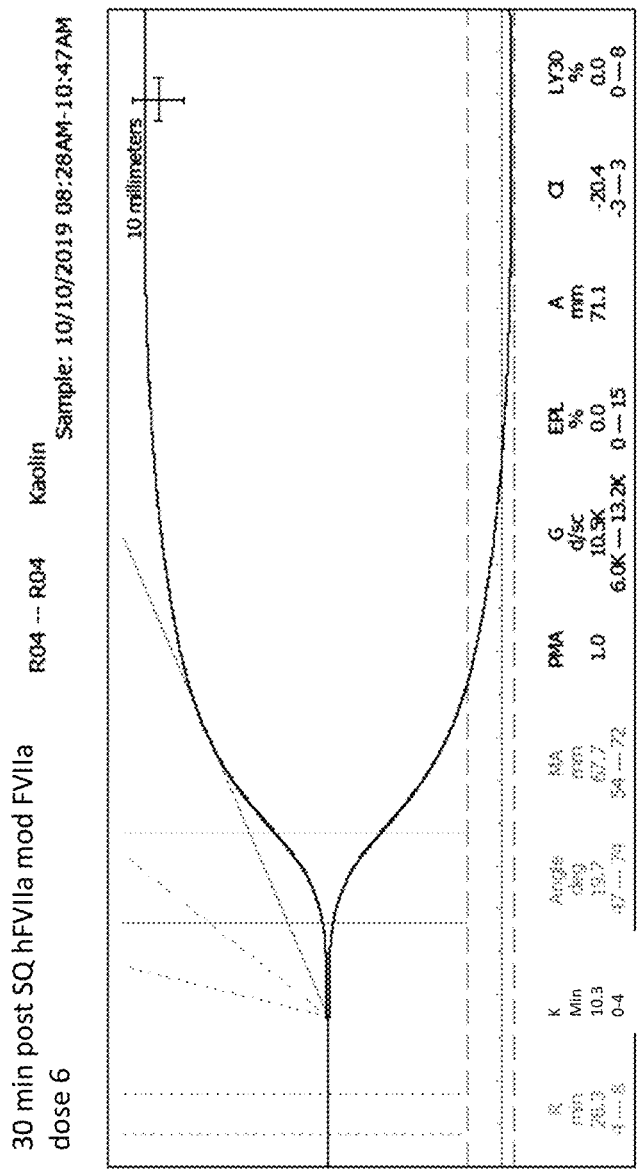
FIG. 22N. R01-TEG Trace 30 Minutes Post-Subcutaneous Mod FVIIa Treatment Dose 6

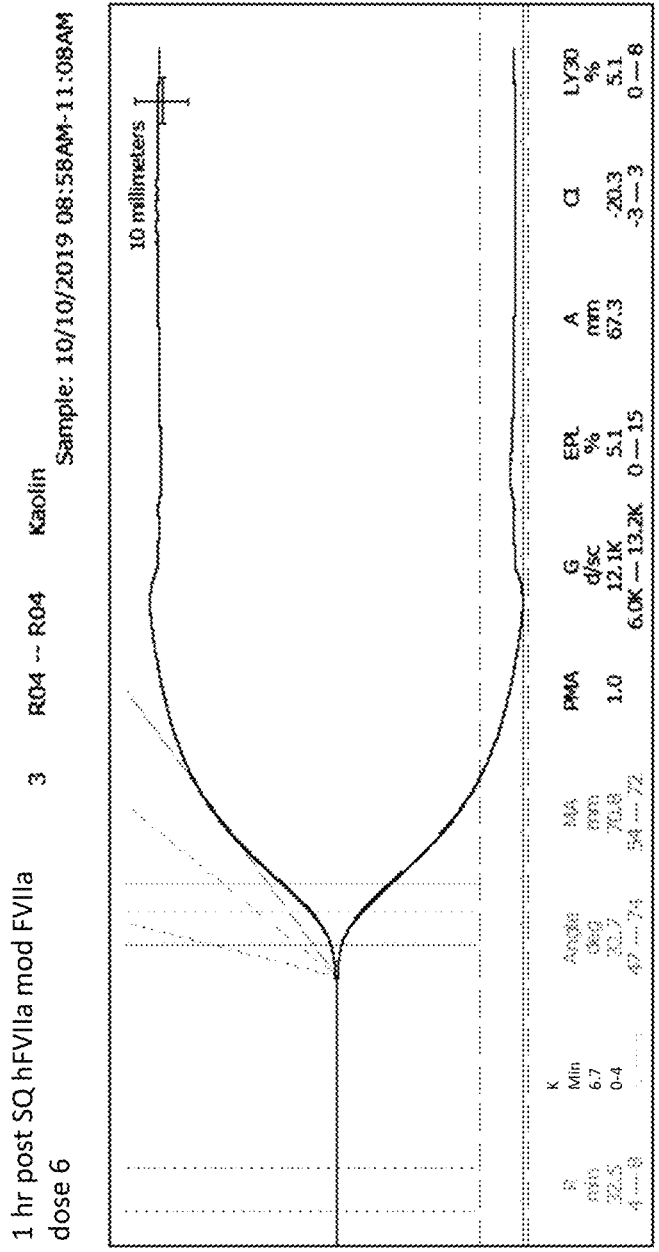
FIG. 22O. R04-TEG Trace 1 Hour Post-Subcutaneous Mod FVIIa Treatment Dose 6

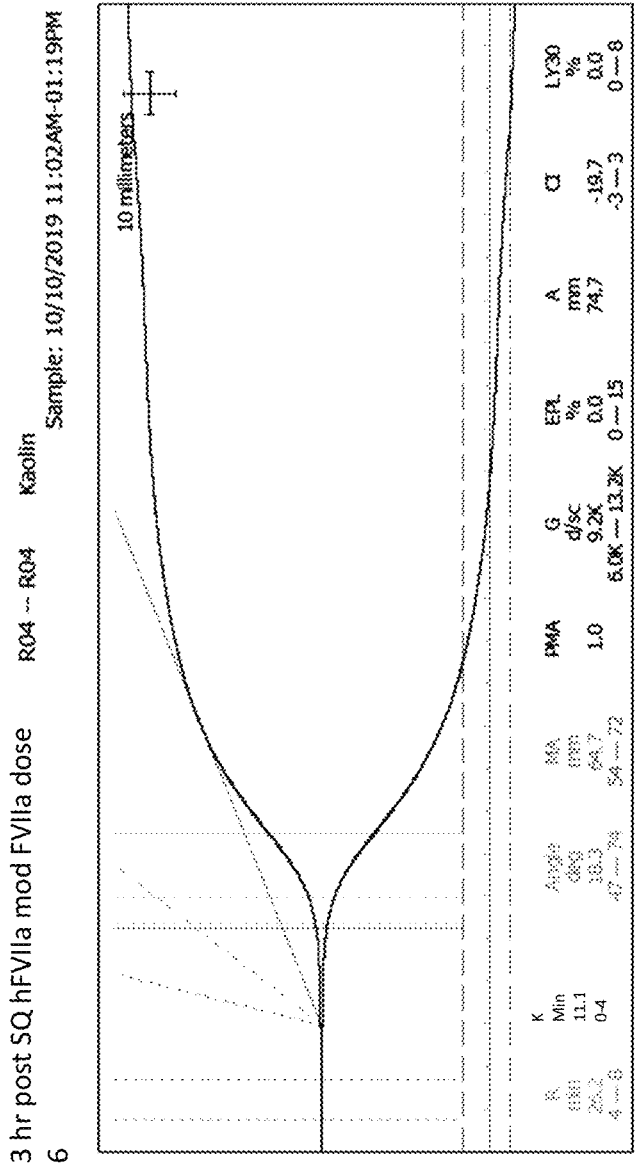
FIG. 22P. R01-TEG Trace 3 Hours Post-Subcutaneous Mod FVIIa Treatment Dose 6

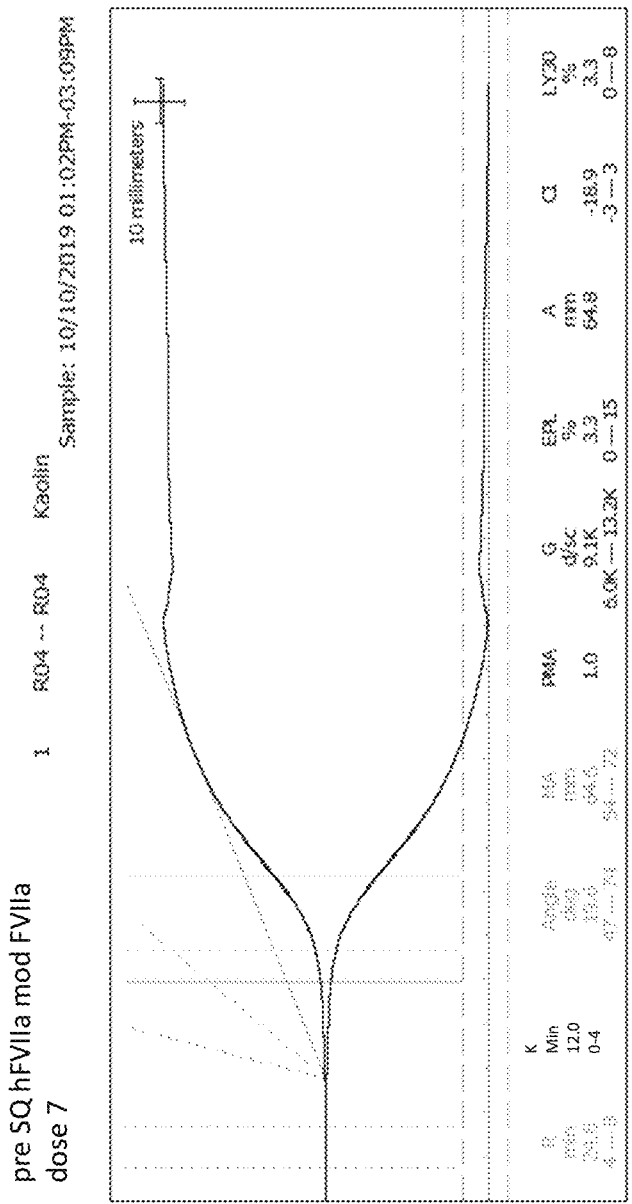
FIG. 22Q. R04-TEG Trace Pre-Subcutaneous Mod FVIIa Treatment Dose 7

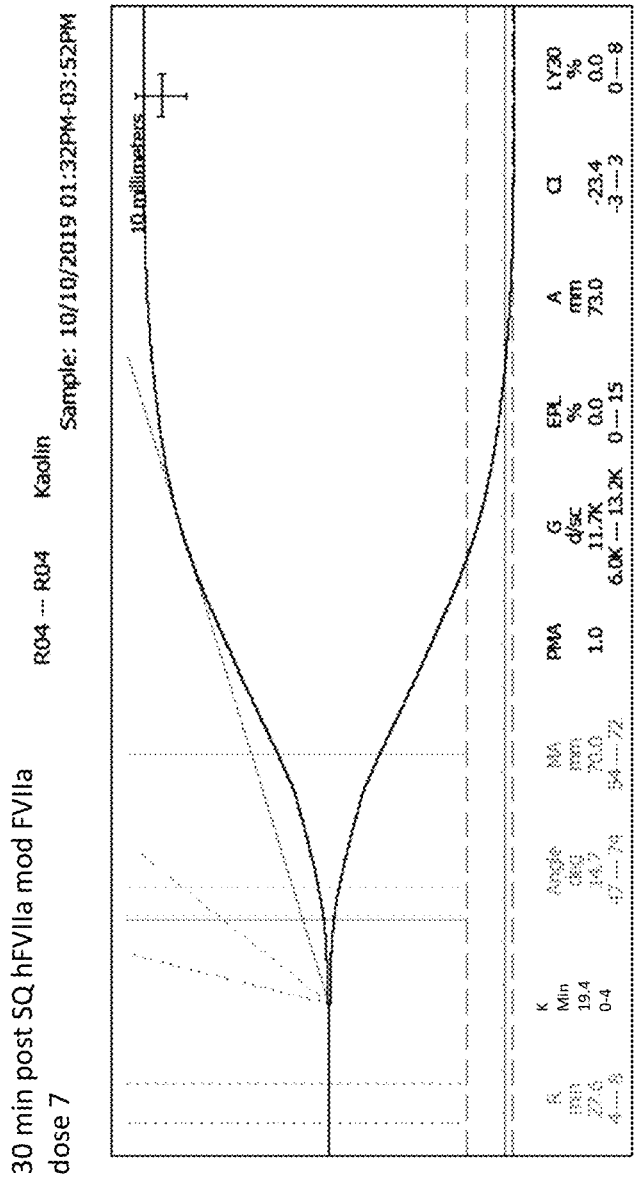
FIG. 22R. R01-TEG Trace 30 Minutes Post-Subcutaneous Mod FVIIa Treatment Dose 7

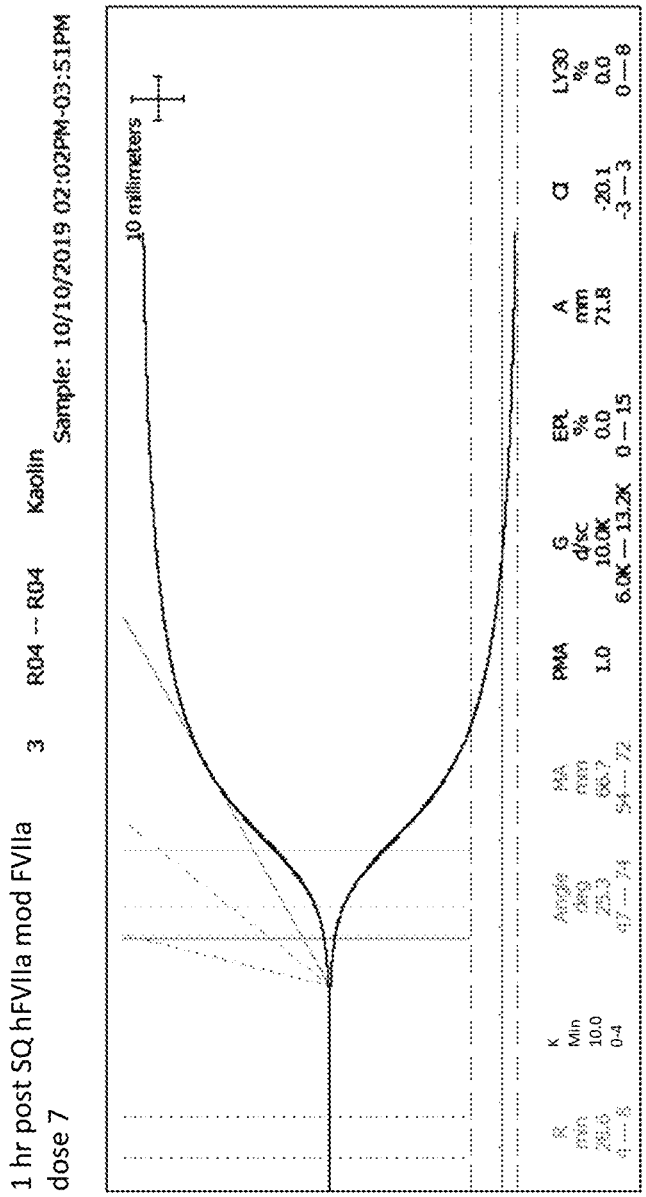
FIG. 22S. R04-TEG Trace 1 Hour Post-Subcutaneous Mod FVIIa Treatment Dose 7

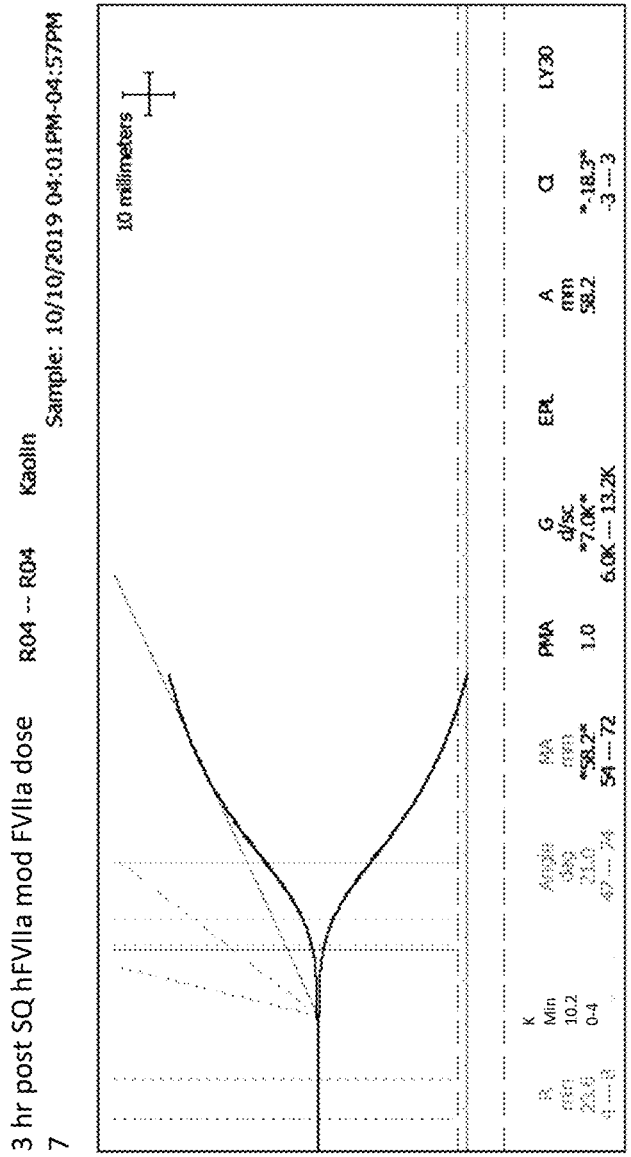
FIG. 22T. R01-TEG Trace 3 Hours Post-Subcutaneous Mod FVIIa Treatment Dose 7

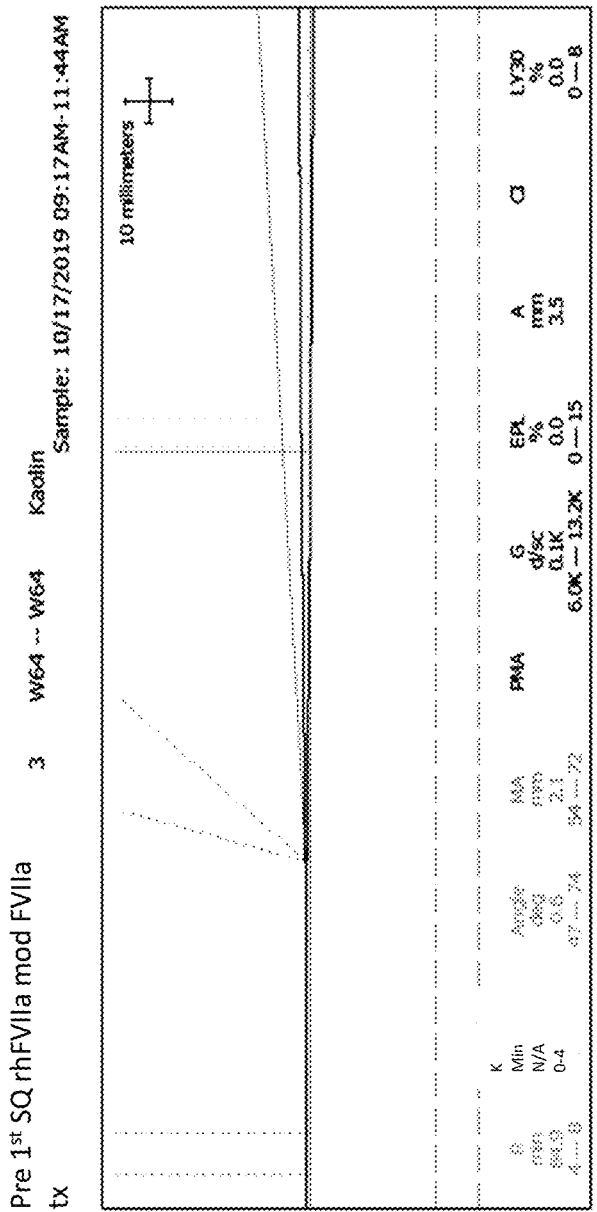
FIG. 23A. W64-TEG Trace Pre-Subcutaneous Mod FVIIa Treatment

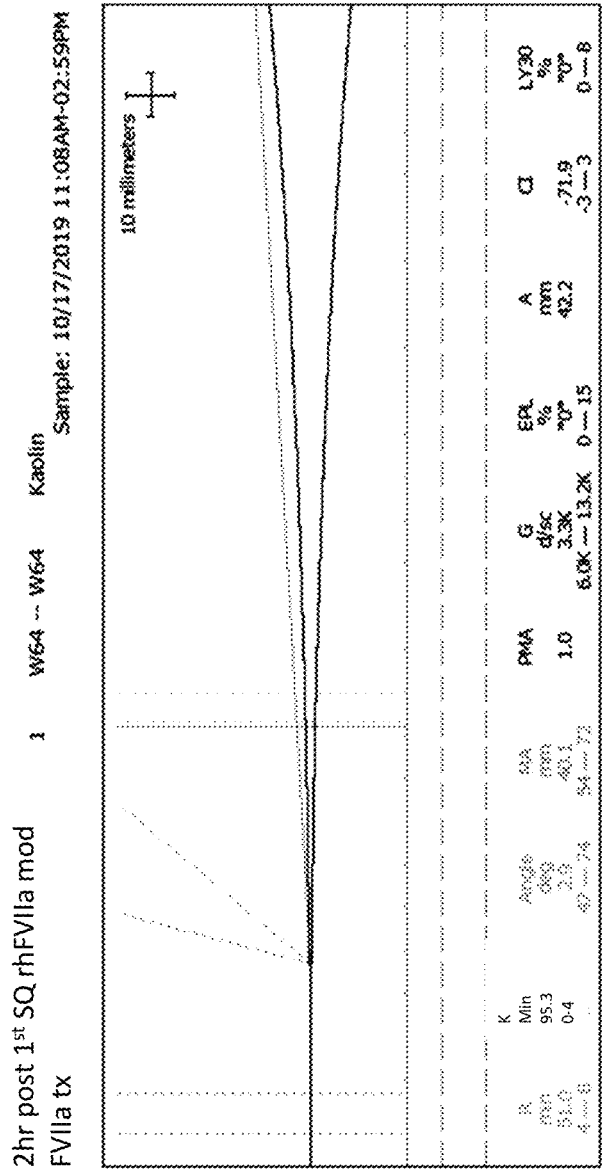
FIG. 23B. W64-TEG Trace 2 Hours Post-Subcutaneous Mod FVIIa Treatment

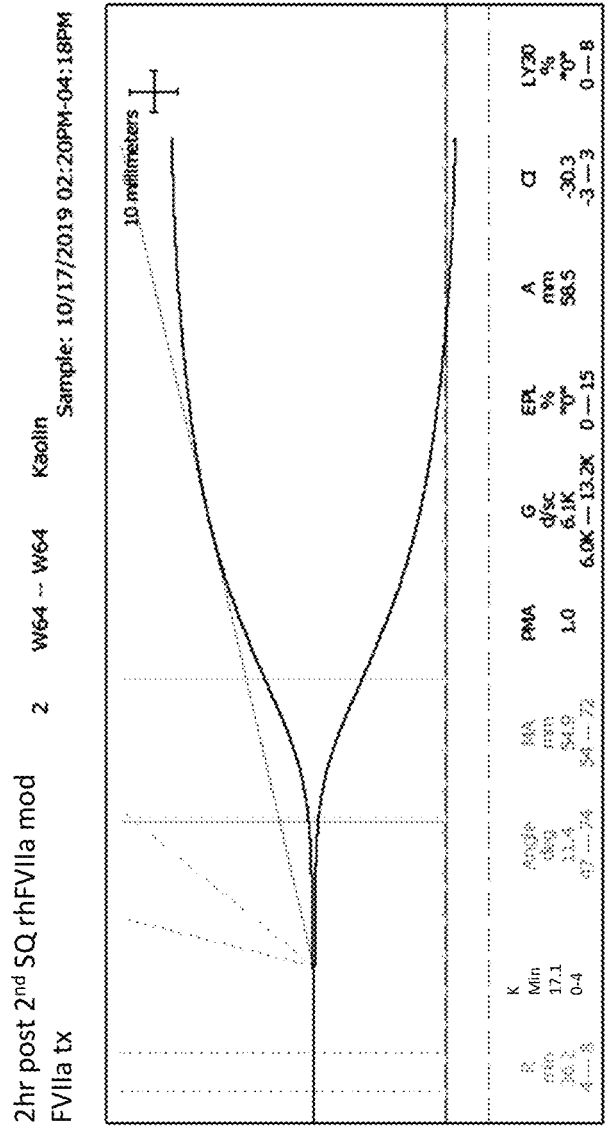
FIG. 23C. W64-TEG Trace 2 hours Post-Subcutaneous Mod FVIIa Treatment Dose 2

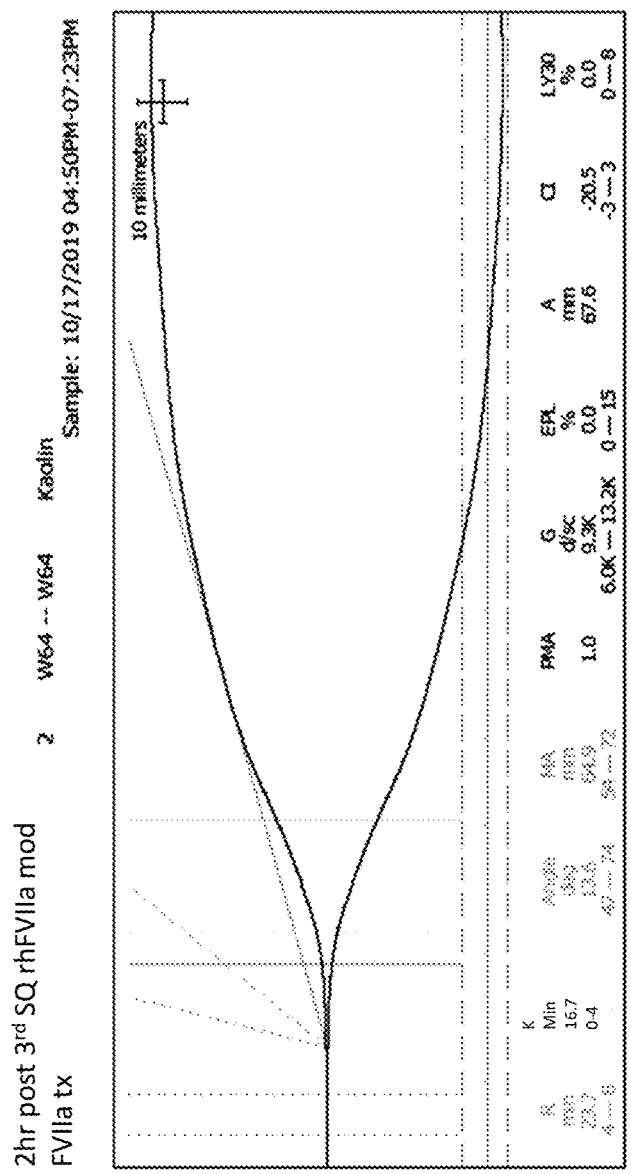
FIG. 23D. W64-TEG Trace 2 Hours Post-Subcutaneous Mod FVIIa Treatment Dose 3

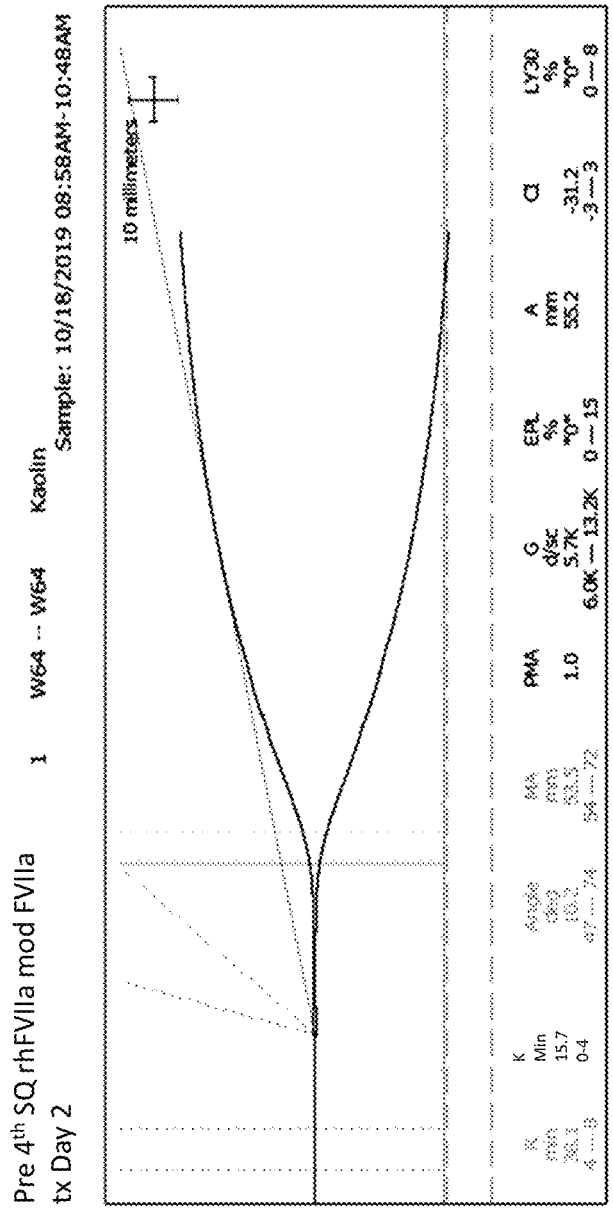
FIG. 23E. W64-TEG Trace Pre-Subcutaneous Mod FVIIa Treatment Dose 4, Day 2

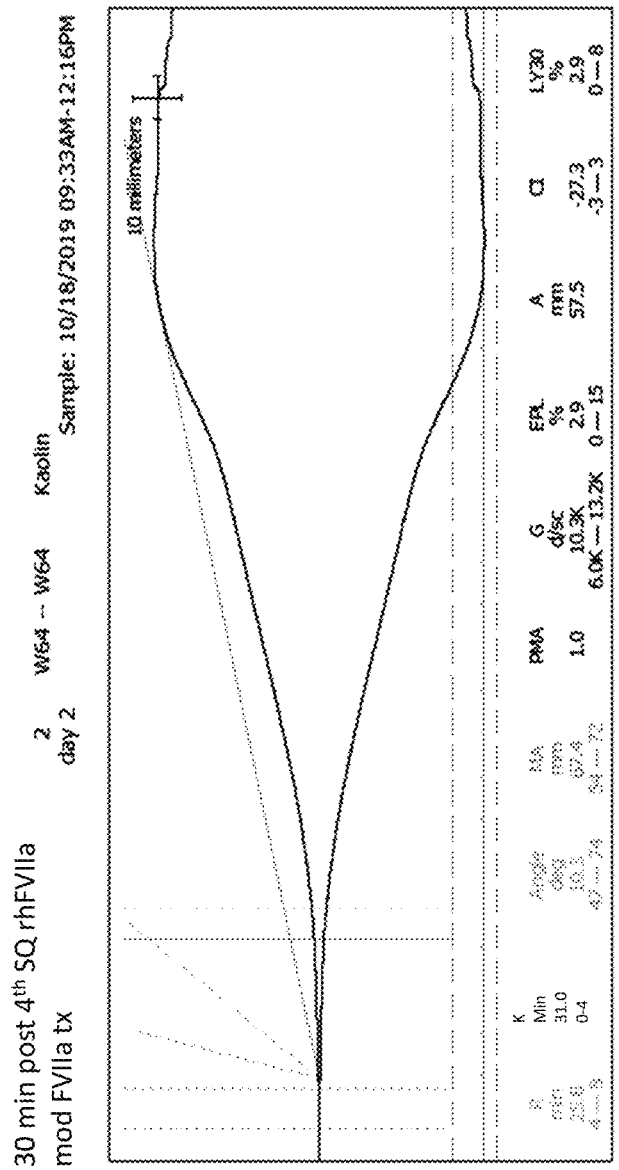
FIG. 23F. W64-TEG Trace 30 Minutes Post-Subcutaneous Mod FVIIa Treatment Dose 4, Day 2

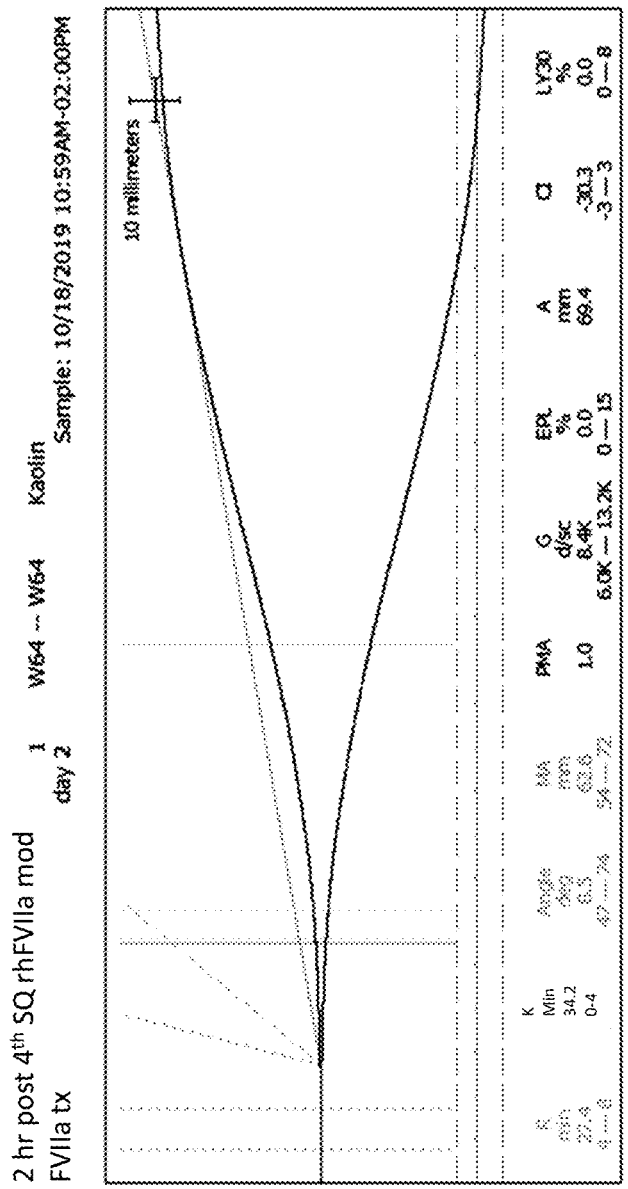
FIG. 23G. W64-TEG Trace 2 Hour Post-Subcutaneous Mod FVIIa Treatment Dose 4, Day 2

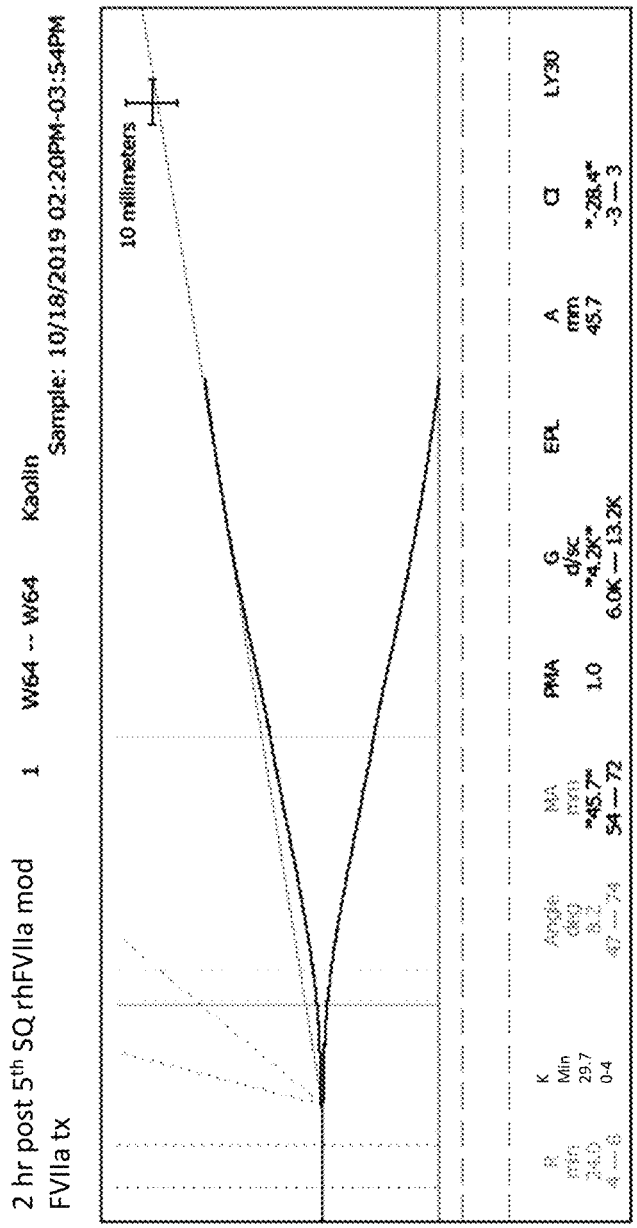
FIG. 23H. W64-TEG Trace 2 Hour Post-Subcutaneous Mod FVIIa Treatment Dose 5

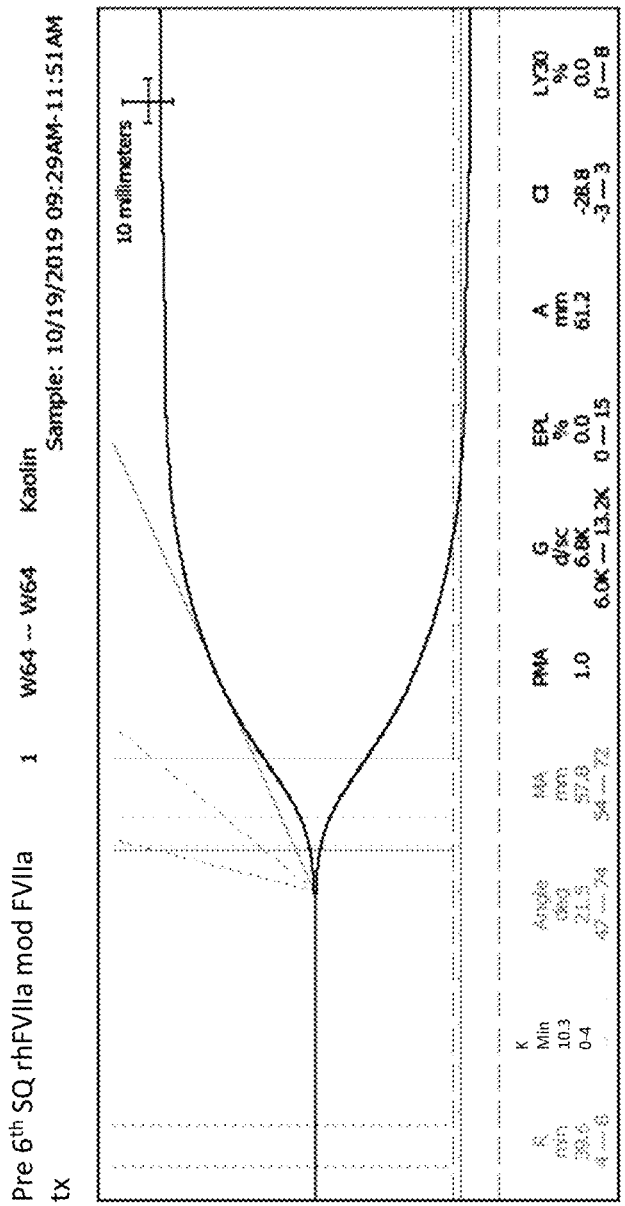
FIG. 23l. W64-TEG Trace Pre-Subcutaneous Mod FVIIa Treatment Dose 6

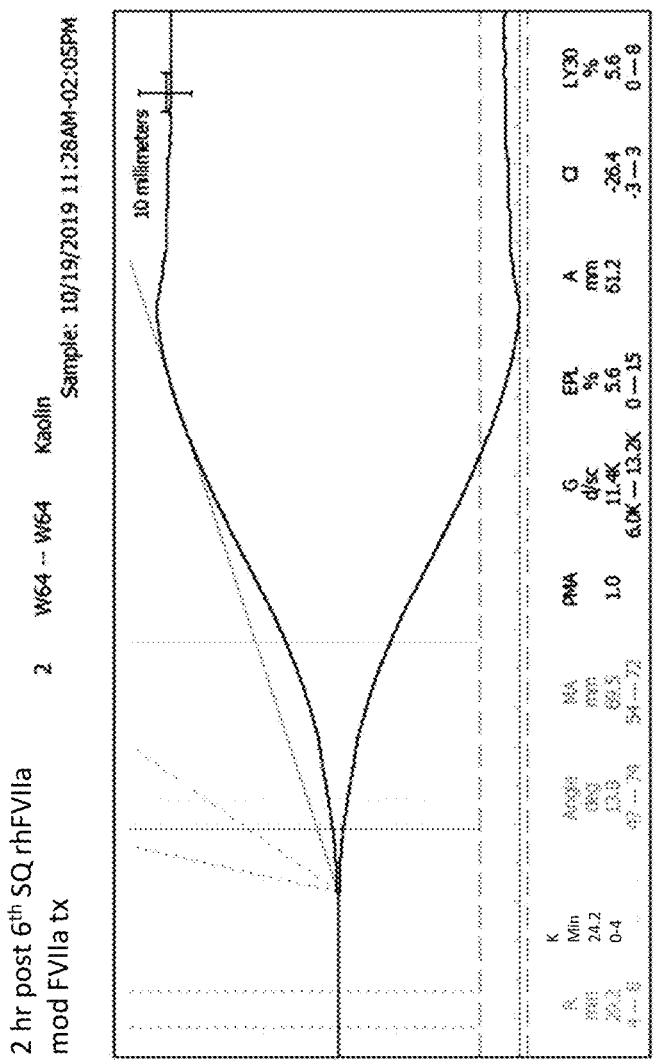
FIG. 23J. W64-TEG Trace 2 Hour Post-Subcutaneous Mod FVIIa Treatment Dose 6

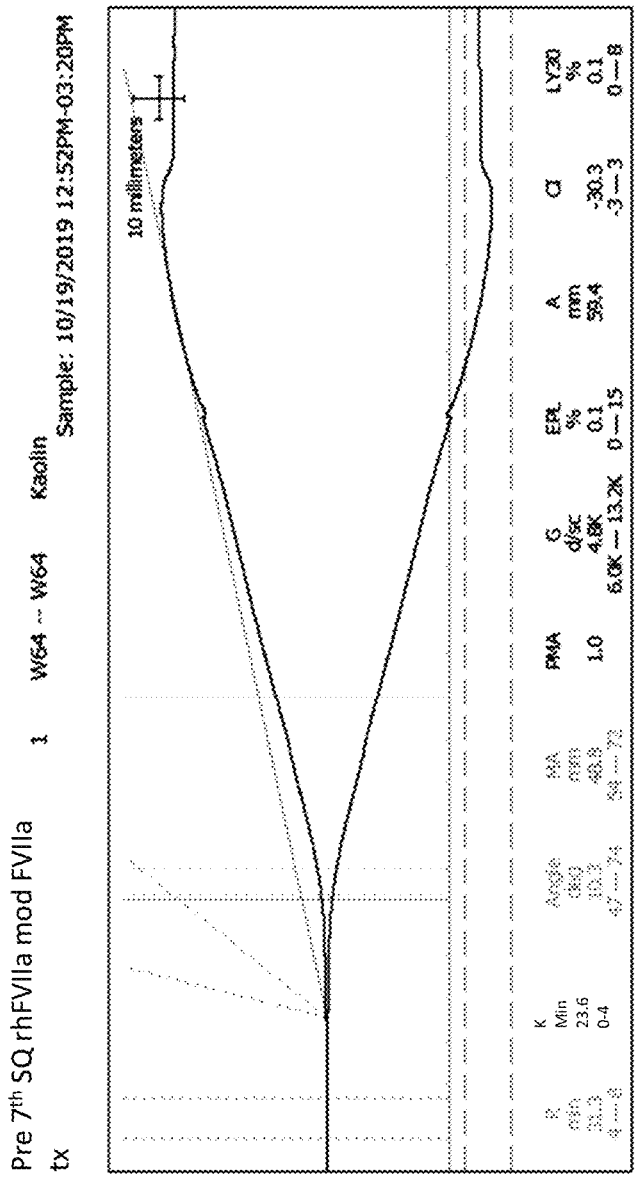
FIG. 23K. W64-TEG Trace Pre-Subcutaneous Mod FVIIa Treatment Dose 7

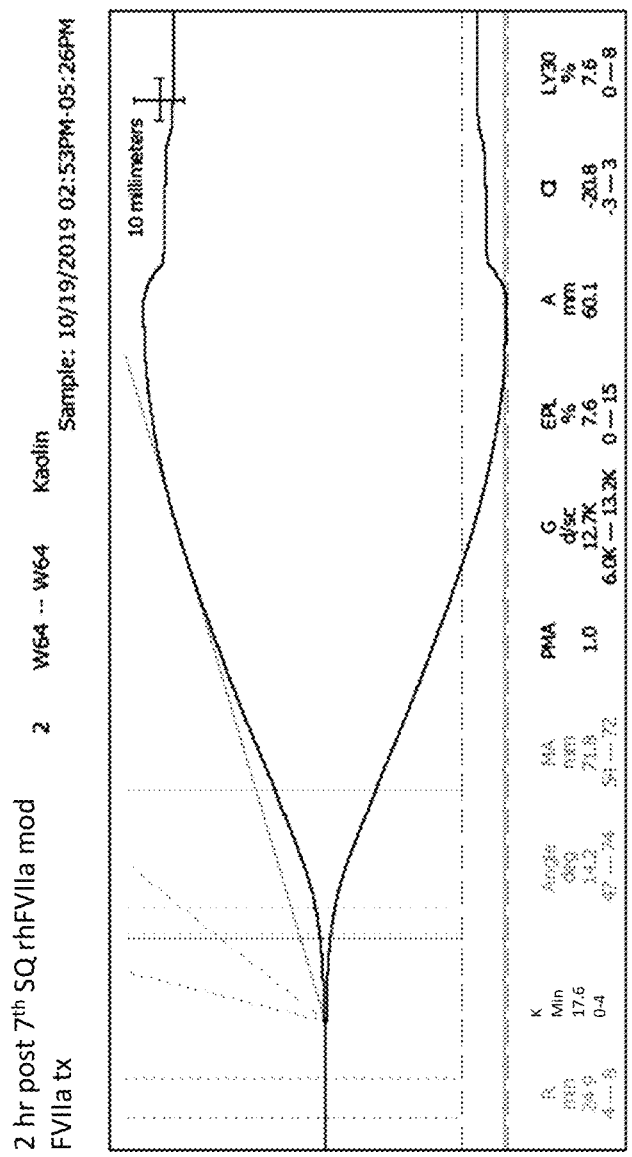
FIG. 23L. W64-TEG Trace 2 Hour Post-Subcutaneous Mod FVIIa Treatment Dose 7

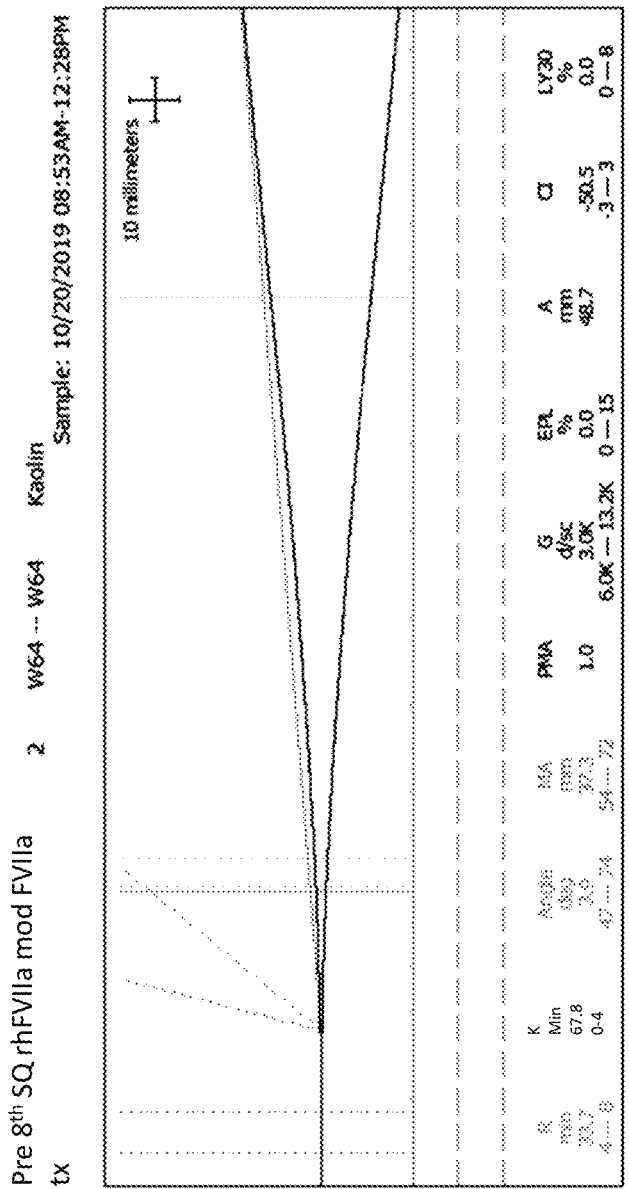
FIG. 23M. W64-TEG Trace Pre-Subcutaneous Mod FVIIa Treatment Dose 8

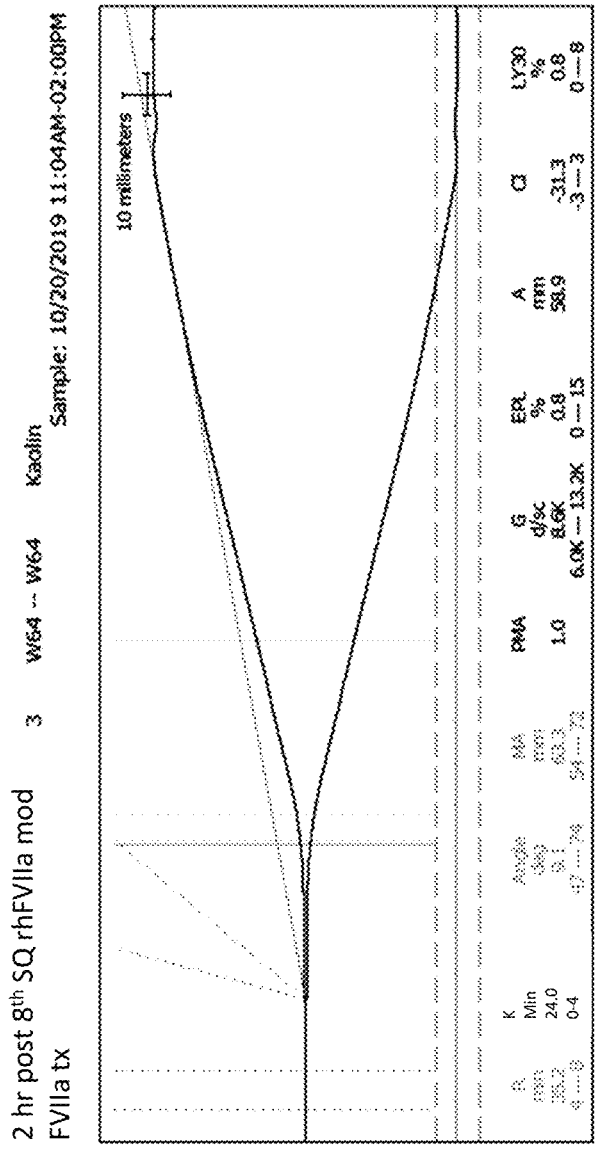
FIG. 23N. W64-TEG Trace 2 Hour Post-Subcutaneous Mod FVIIa Treatment Dose 8

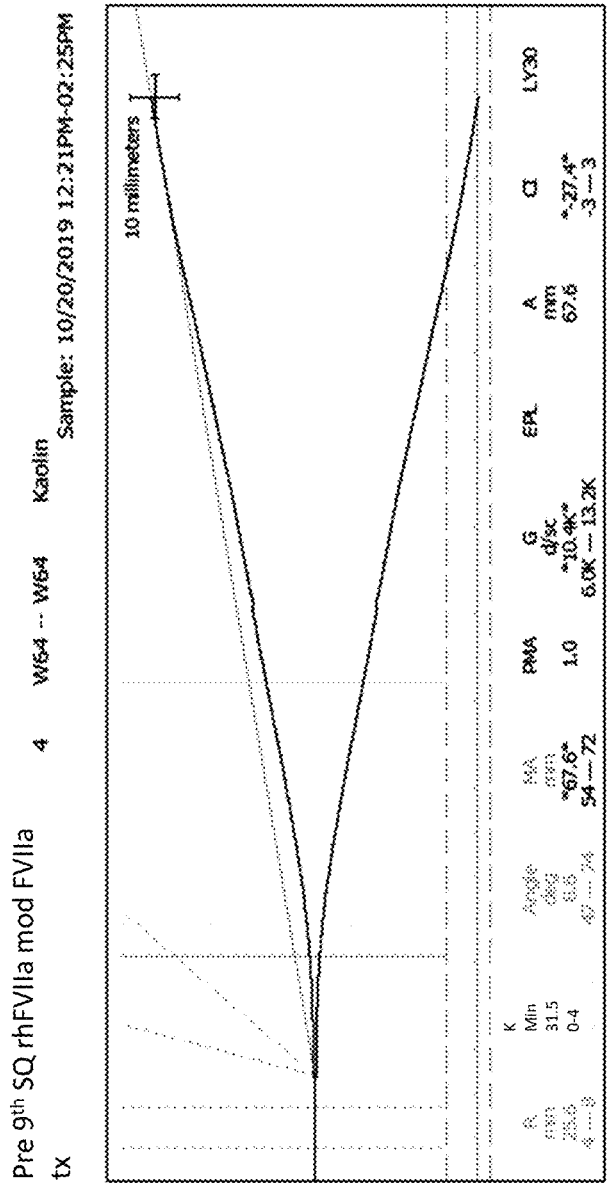
FIG. 23O. W64-TEG Trace Pre-Subcutaneous Mod FVIIa Treatment Dose 9

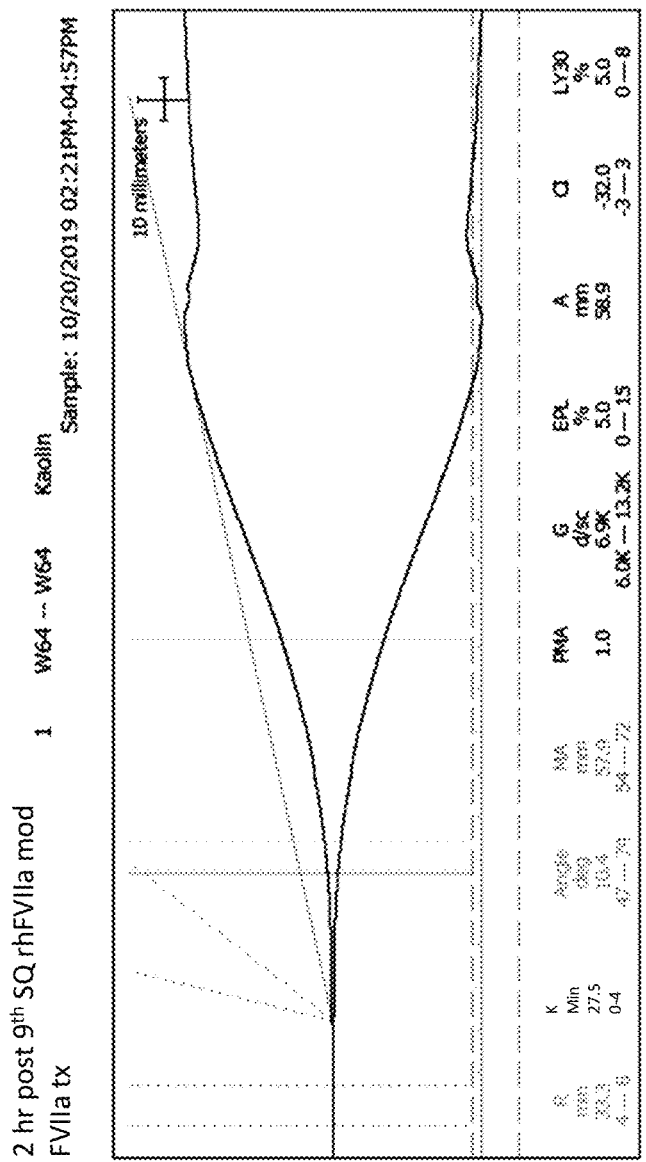
FIG. 23P. W64-TEG Trace 2 Hour Post-Subcutaneous Mod FVIIa Treatment Dose 9

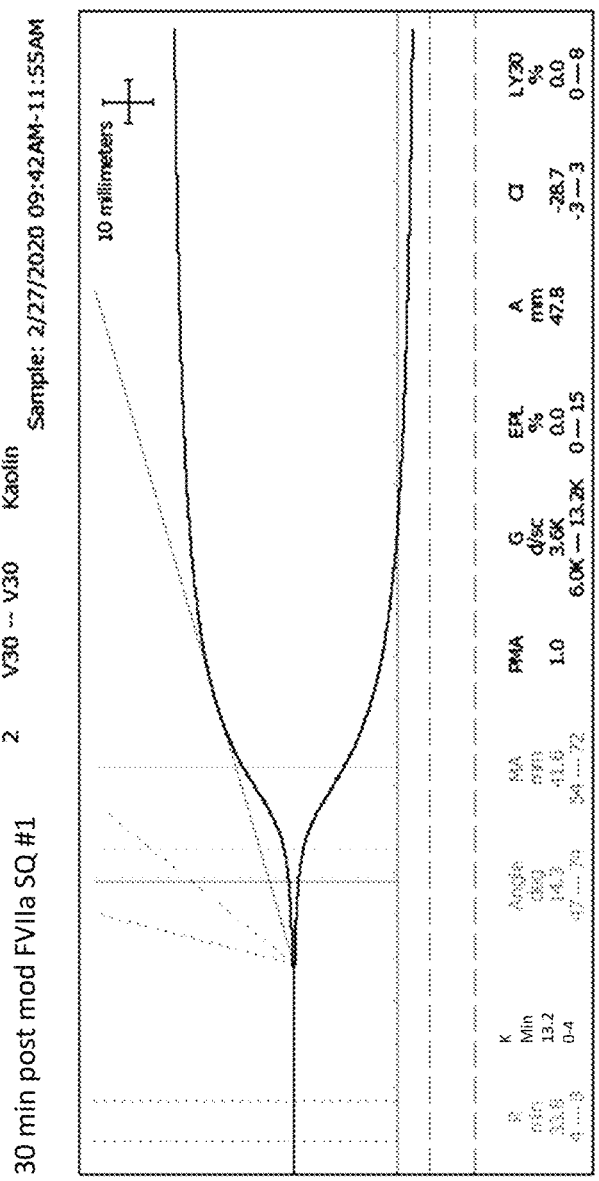
FIG. 24A. V30-TEG Trace 30 Minutes Post-Subcutaneous Mod FVIIa Treatment Dose 1

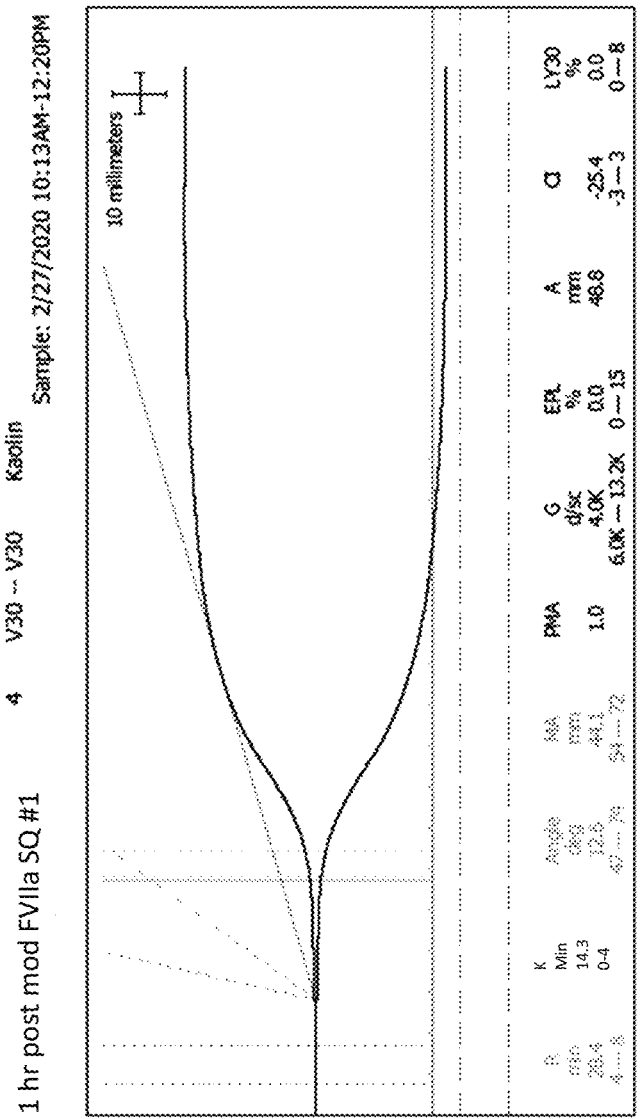
FIG. 24B. V30-TEG Trace 1 Hour Post-Subcutaneous Mod FVIIa Treatment Dose 1

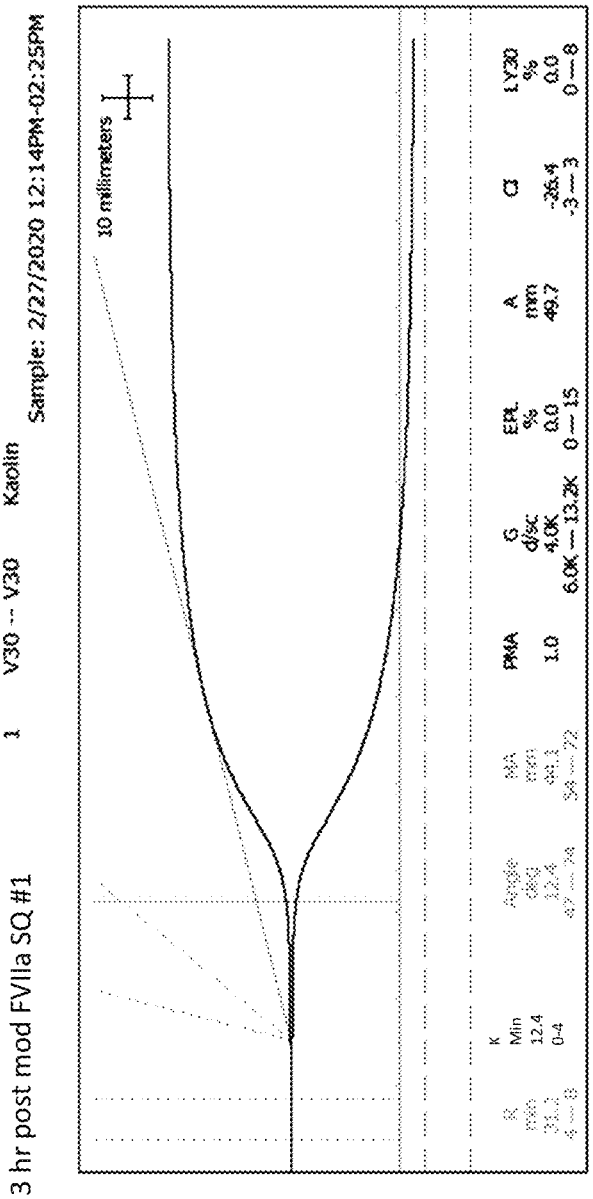
FIG. 24C. V30-TEG Trace 3 Hours Post-Subcutaneous Mod FVIIa Treatment Dose 1

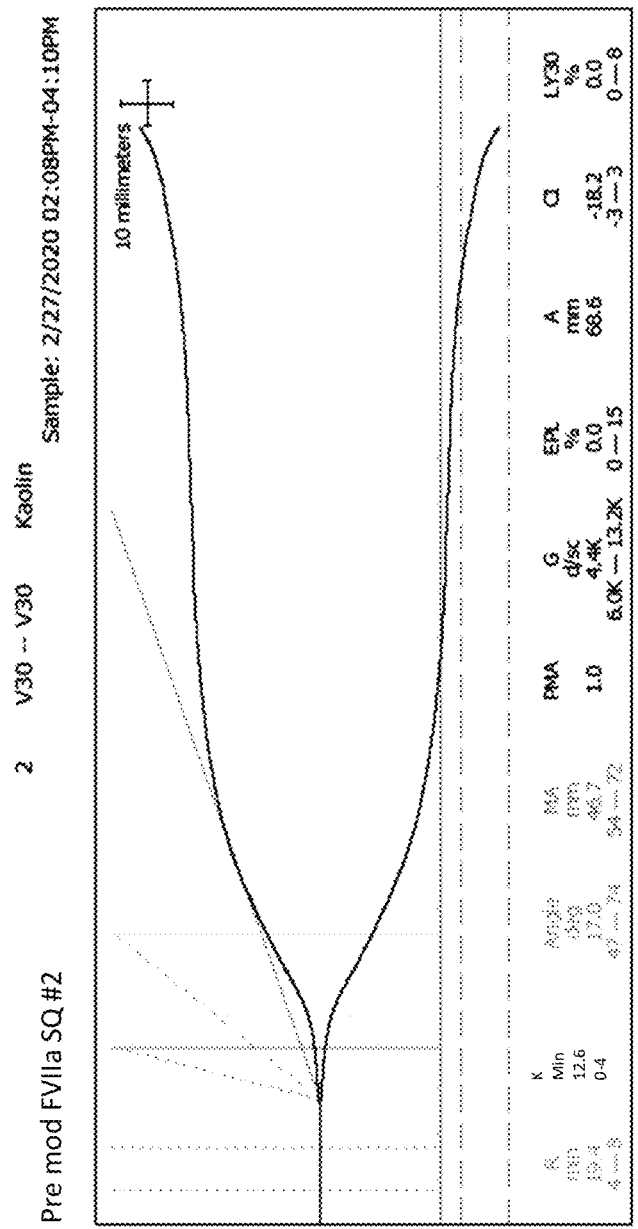
FIG. 24D. V30-TEG Trace Pre-Subcutaneous Mod FVIIa Treatment Dose 2

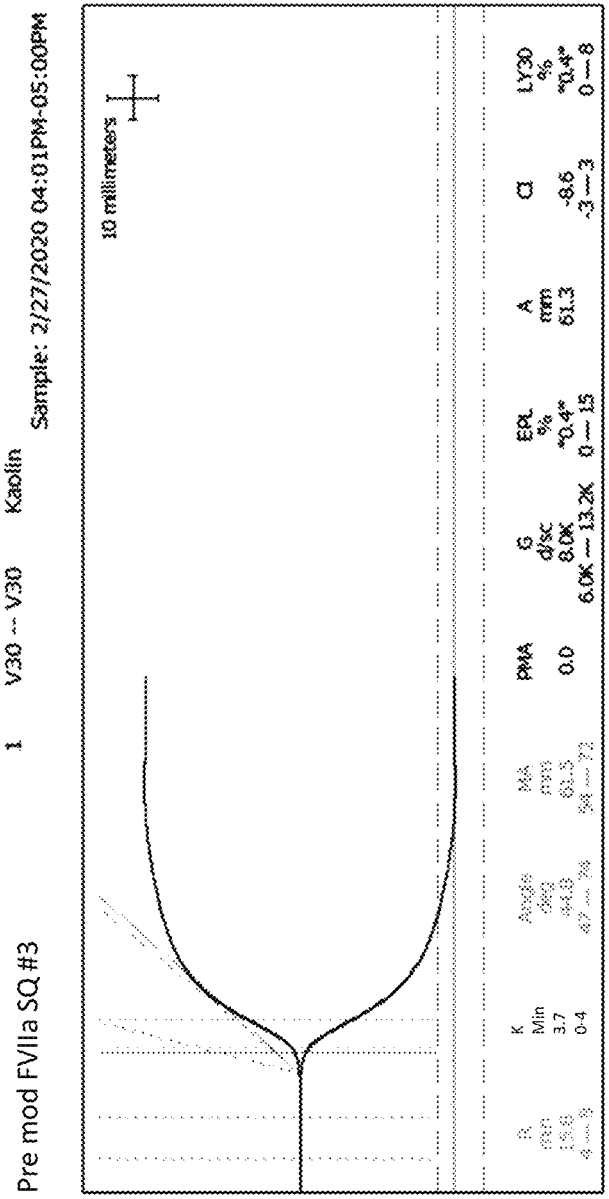
FIG. 24E. V30-TEG Trace Pre-Subcutaneous Mod FVIIa Treatment Dose 3

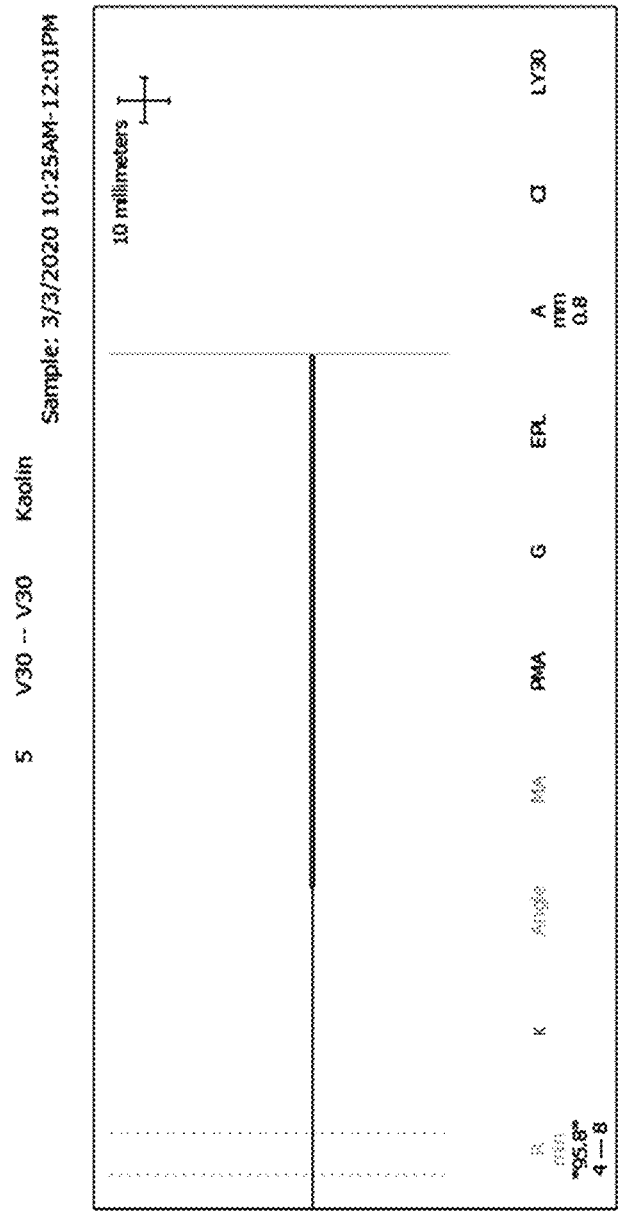
FIG. 24F. V30-TEG Trace Reverted to Untreated Baseline

MODIFIED FACTOR VII POLYPEPTIDES FOR SUBCUTANEOUS ADMINISTRATION AND ON-DEMAND TREATMENT

CROSS-REFERENCE TO RELATED APPLICATIONS

This application is a continuation of U.S. patent application Ser. No. 16/994,573, filed Aug. 15, 2020, which claims priority to U.S. Provisional Patent Application No. 63/010,656, filed Apr. 15, 2020, and U.S. Provisional Patent Application No. 62/970,152, filed Feb. 4, 2020, and U.S. Provisional Patent Application No. 62/887,599, filed Aug. 15, 2019, each of which is hereby incorporated by reference in its entirety.

REFERENCE TO SEQUENCE LISTING

An electronic version of the Sequence Listing is filed herewith, the contents of which are incorporated by reference in their entirety. The electronic file was created on Aug. 12, 2020, is 1.23 megabytes in size, and is titled CTBI_003_03US_SeqList_ST25.txt.

BACKGROUND

The coagulation cascade pathway is a proteolytic pathway where each enzyme is present in the plasma as a zymogen, or unactive form. Cleavage of the zymogen is regulated to release the active form from the precursor molecule. The pathway functions as a series of positive and negative feedback loops which control the activation process, where the ultimate goal is to produce thrombin, which can then convert soluble fibrinogen into fibrin to form a clot. Generally, these factors in the coagulation pathway participate in blood coagulation through one or more of the intrinsic, extrinsic or common pathway of coagulation (see FIG. 1).

Factor VII (FVII) is a vitamin K-dependent serine protease glycoprotein that is synthesized in animals, including mammals, as a single-chain zymogen in the liver and secreted into the blood stream. FVII is the coagulation protease responsible for initiating the cascade of proteolytic events that lead to thrombin generation and fibrin deposition. The vast majority of FVII in the blood is in the form of an unactive single-chain zymogen, although a small amount is present in a two-chain activated form, referred to herein as "FVIIa" or "FVIIa polypeptide." Accordingly, "activated Factor VII" or "FVIIa" refers to any activated, two-chain form of a FVII polypeptide, and "unactivated FVII" or "FVII" generally refers to an unactivated, single-chain zymogen form of the Factor VII polypeptide. Activation of FVII occurs upon proteolytic cleavage of the $Arg^{152}$-$Ile^{153}$ bond (positions relative to the mature human FVII polypeptide), giving rise to a two-chain polypeptide containing a 152 amino acid light chain (approximately 20 kDa) linked by a disulfide bridge to a 254 amino acid heavy chain (approximately 30 kDa). Cleavage of FVII from its zymogen form to FVIIa however is not sufficient for full activity. FVIIa requires complexation with tissue factor (TF) for full activity. Additionally, though a two-chain form typically results from proteolytic cleavage, it can also be produced synthetically. Activated Factor VII, thus, includes the zymogen-like two-chain form with low coagulant activity, a fully activated form (about 1000-fold more activity that occurs upon binding to tissue factor, and mutated forms that exist in a fully activated two-chain form or undergo conformation change to a fuly activated form.

In hemophilia patients, bleeding is the main clinical manifestation and can occur spontaneously, related to trauma, or during and after surgical procedures. For example, individuals with hemophilia generally bleed longer or out of proportion to the degree of injury when compared to an individual without hemophilia. Patients having Hemophilia A (HA) or Hemophilia B (HB) are characterized by a deficiency of coagulation Factor VIII (FVIII) in HA, or Factor IX (FIX) in HB. These patients generally are initially treated by factor replacement therapy. However, some patients with HA or HB may develop neutralizing antibodies, referred to herein also as "inhibitors," against wild-type FVIII or FIX in response to the factor replacement therapy, causing the replacement therapy to become ineffective.

The role of FVII in clot formation has attracted significant interest in FVII as a target for clinical anti-coagulant and hemostatic therapies. Patients with hemophilias and other bleeding disorders, including Hemophilia A or B with and without inhibitors, lack treatment options that are fast and easy to use for treating acute bleeding. Provided herein are methods and compositions using Factor VII polypeptides that address this need.

SUMMARY

Provided herein are methods for on-demand administration of modified FVIIa polypeptides for treating bleeding in subjects with bleeding disorders, including hemophilia A, hemophilia B, hemophilia A or B with inhibitors, hemophilia C, FVII deficiency, acquired hemophilia, Glanzmann thrombasthenia, bleeding in subjects treated with anti-coagulants, and other such subjects. The bleeding in subjects also includes bleeding resulting from trauma, such as injury, and episodic bleeding, such as from surgery and/or menstruation, and other bleeds, such as joint bleeds, experienced by subjects with hemophilia and other coagulation disorders.

In some embodiments, the modified FVII and FVIIa polypeptides include modifications at least at a position corresponding to position 286 and at a position corresponding to position 298 in a polypeptide comprising the sequence of amino acids set forth in SEQ ID NO: 3 or in a corresponding residue in a polypeptide, wherein the modification at position 286 is an amino acid replacement with Arg (R), and the modification at position 298 is an amino acid replacement with Gln (Q), and optionally further including a at position corresponding to position 128 and at a position corresponding to position 129 in the FVII polypeptide having the sequence of amino acids set forth in SEQ ID NO: 3, wherein: the modification at position 128 is an amino acid replacement with Asn (N); and the modification at position 129 is Ala (A). These modified polypeptides are provided for use for on-demand treatment to prevent or treat a bleeding event by subcutaneous administration. These modified polypeptides exhibit increased coagulation activity as compared to an unmodified FVII. Provided also are methods of treatment, and dosing paradigms for subcutaneous administration using such modified polypeptides. Of particular note, it is surprising and unexpected that subcutaneous administration of modified activated polypeptides exhibit increased potency, coagulation activity, and extended duration and prolonged exposure, as compared to an unmodified FVII, at doses lower than would have been expected. In some exemplary embodiments, such modified activated polypeptides include those comprising the amino acid sequence set forth in SEQ ID NO: 280, or SEQ ID NO: 138.

Accordingly, in one aspect, provided herein are methods of treating a bleeding event in a subject, comprising subcutaneously administering to the subject a dose of a modified Factor VIIa comprising modifications at least at a position corresponding to position 286 and at a position corresponding to position 298 in a FVII polypeptide comprising the sequence of amino acids set forth in SEQ ID NO: 3 or in a corresponding residue in a FVII polypeptide, wherein the modification at position 286 is an amino acid replacement with Arg (R); the modification at position 298 is an amino acid replacement with Gln (Q); the subcutaneous administration of the modified FVIIa has increased activity or potency; and a dose of the modified FVIIa is administered subcutaneously within about 5 or 4 or 3 or 2 or 1 or fewer hours or minutes before and/or after the bleeding event, whereby the amount of bleeding is reduced or stopped or the cause of the bleed is corrected or is healed. In another aspect, provided herein are methods of providing an on-demand treatment to a subject experiencing a bleed or to a subject likely to experience a bleed, comprising administering to the subject a subcutaneous dose of a modified FVIIa comprising modifications at least at a position corresponding to position 286 and at a position corresponding to position 298 in a FVII polypeptide comprising the sequence of amino acids set forth in SEQ ID NO: 3 or in a corresponding residue in a FVII polypeptide, wherein: the modification at position 286 is an amino acid replacement with Arg (R); the modification at position 298 is an amino acid replacement with Gln (Q); and the dose is about 10 to about 120 µg/kg of body weight of the subject.

In some embodiments, the modified FVIIa further comprises a modification at a position corresponding to position 128 in the FVII polypeptide having the sequence of amino acids set forth in SEQ ID NO: 3, wherein: the modification at position 128 is an amino acid replacement with Asn (N). In some embodiments, the modified FVIIa further comprises a modification at a position corresponding to position 129 and in the FVII polypeptide having the sequence of amino acids set forth in SEQ ID NO: 3, wherein: the modification at position 129 is Ala (A).

In some embodiments, the dose of the modified FVIIa is administered subcutaneously within about 5 or 4 or 3 or 2 or 1 or fewer hours or minutes after the bleeding event. In some embodiments, the dose of the modified FVIIa is administered subcutaneously within about 5 or 4 or 3 or 2 or 1 or fewer hours or minutes before the bleeding event. In some embodiments, a repeated subcutaneous dose of the modified FVIIa is administered subcutaneously every 3-7, 2-5, 4-6, or 4-12 hours until the bleeding stops, the cause is corrected, or any wound is healed or for 1 to 2, 3, 4, or 5 days. In some embodiments, the dose of modified FVIIa is administered every 1, 2, 3, 4, 5, 6, 7, 8, 9, 10, 11, or 12 hours. In some embodiments, the bleeding is episodic or predictable by the subject; and the subject is treated with a subcutaneous dose of the modified FVIIa before the bleeding starts. In some embodiments, the bleeding event results from trauma or injury; and the subject is treated with a subcutaneous dose of the modified FVIIa 15 minutes, 1, 2, 3, or 4 hours after the bleeding event. In some embodiments, the subject has a hemophilia or other bleeding disorder or condition, and is undergoing surgery; a dose of the modified FVIIa is subcutaneously administered 5, 4, 3, 2, 1 hours or less before surgery; the subject is treated with a FVIIa intravenously during surgery; and a dose of the modified FVIIa is subcutaneously administered at least one time following surgery until there is no bleeding and/or risk of bleeding or until the subject is healed or the cause is corrected. In some embodiments, the subject has a hemophilia or other bleeding disorder or condition, and is undergoing surgery; a dose of the modified FVIIa is administered to the subject at least 4 hours, or 3 hours, or 2 hours, or 1 hour before surgery; a dose of the modified FVIIa is subcutaneously administered 2 to 3 hours after surgery; the modified FVIIa is optionally administered again after another 2 to 3 hours; and the modified FVIIa is administered once or twice a day thereafter until the subject is healed or the cause of the bleeding is corrected. In some embodiments, the subject has a hemophilia or other bleeding disorder or condition, and is undergoing surgery; and a dose of the modified FVIIa is subcutaneously administered every 4 to 6 hours after surgery until bleeding stops or the subject is healed or the cause of the bleeding is corrected.

In some embodiments, the bleeding is due to surgery or trauma. In some embodiments, the bleeding is the result of a trauma or injury. In some embodiments, the bleeding is manifested as acute hemarthroses, singular hemarthrosis, chronic hemophilic arthropathy, hematoma, hematuria, central nervous system bleeding, gastrointestinal bleeding, bleeding into airways, oral bleeding, spontaneous bleeds, joint bleeds, cerebral hemorrhage, or breakthrough bleeds. In some embodiments, the bleeding is due to dental extraction or bleeding gums. In some embodiments, the bleeding is acute and results from trauma or surgery or the episodic bleeding is menstrual bleeding or joint bleeding or target joint bleeding or a surgical wound that is healed or corrected.

In some embodiments, the bleeding is surgical. In some embodiments, the bleeding is surgical; and the surgery is joint surgery, limb surgery, heart surgery, angioplasty, upper airway surgery, lung surgery, abdominal surgery, spinal surgery, brain surgery, joint replacement, vascular surgery, dental surgery, or organ transplant surgery. In some embodiments, the surgery is transplant surgery selected from among transplantation of bone marrow, heart, lung, pancreas, and liver. In some embodiments, the surgery is hip or knee replacement or arthrodesis.

In some embodiments, administration is every 2-4 hours or 3-6 hours or 4-6 hours. In some embodiments, the modified FVIIa is administered a plurality of times until the bleeding stops or any wound is healed or bleeding is corrected.

In some embodiments, the bleed is episodic or predictable; and the subject is pre-treated prior to the bleeding. In some embodiments, wherein pre-treatment is effected about 4 hours or less before the bleed. In some embodiments, pre-treatment is effected about 3 hours or less, or 2 hours or less, or 1 hour or less before the bleeding. In some embodiments, pre-treatment is effected at least 15 minutes before the bleeding.

In some embodiments, a dose or doses of the modified FVIIa is/are administered subcutaneously before the bleeding. In some embodiments, a dose or doses of the modified FVIIa is administered subcutaneously after the bleeding starts. In some embodiments, a dose of the modified FVIIa is administered within 1 minute up to 2 hours from the start of the bleeding. In some embodiments, the modified FVIIa is administered subcutaneously a plurality of times until the bleeding stops or the wound heals or bleeding is corrected.

In some embodiments, a single dose of the modified FVIIa is from about 10 µg/kg to 30 µg/kg, 10 µg/kg to 60 µg/kg, 10 µg/kg to 90 µg/kg, 10 µg/kg to 120 µg/kg, 30 µg/kg to 60 µg/kg, 30 µg/kg to 90 µg/kg, 30 µg/kg to 120 µg/kg, 10 µg/kg to 500 µg/kg, or 15 µg/kg to 400 µg/kg, or 15 µg/kg to 350 µg/kg, or 20 µg/kg to 400 µg/kg, or 20 µg/kg to 350 µg/kg, or 30 µg/kg to 350 µg/kg, or 25 µg/kg to 350 µg/kg, based on the weight of the treated subject. In some embodiments, a single dose of modified FVIIa is from about 10

µg/kg to 500 µg/kg, or 15 µg/kg to 400 µg/kg, or 15 µg/kg to 350 µg/kg, or 20 µg/kg to 400 µg/kg, or 20 mg/kg to 350 µg/kg, or 30 µg/kg to 350 µg/kg, or 25 µg/kg to 350 µg/kg per dose. In some embodiments, a single subcutaneous dose of the modified FVIIa is in a volume of 10 mL or less or 5 mL or less. In some embodiments, a single subcutaneous dose of the modified FVIIa is in a volume of 1 mL to 2 mL, or 1.25 mL to 1.5 mL, or 1 mL to 10 mL.

In some embodiments, the methods provided herein further comprise administering an additional coagulant treatment or factor. In some embodiments, the treatment comprises administration of antibody emicizumab-kxwh and/or a factor eight inhibitor bypass activity product. In some embodiments, wherein the additional coagulation factor is selected from among one or more of plasma purified or recombinant coagulation factors, procoagulants, such as vitamin K, vitamin K derivative and protein C inhibitors, plasma, platelets, red blood cells and corticosteroids. In some embodiments, the methods provided herein further comprise administering an anti-tissue factor pathway inhibitor (TFPI) antibody. In some embodiments, the anti-TFPI antibody is concizumab. In some embodiments, the methods provided herein further comprise administering an RNA interference (RNAi) therapeutic targeting antithrombin (AT). In some embodiments, the RNAi therapeutic targeting AT is fitusiran.

In some embodiments, the subject treated in the methods provided herein has a disease or condition selected from among blood coagulation disorders, hematologic disorders, hemorrhagic disorders, hemophilias, and other bleeding disorders. In some embodiments, the subject has hemophilia A, hemophilia B, hemophilia A with inhibitors, hemophilia B with inhibitors, Factor VII deficiency, Glanzmann thrombasthenia, acquired hemophilia, or is taking anti-coagulant therapy. In some embodiments, the subject has a hemophilia; and the hemophilia is selected from among hemophilia A, hemophilia B and hemophilia C, hemophilia A with inhibitors, and hemophilia B with inhibitors. In some embodiments, the hemophilia is congenital. In some embodiments, the hemophilia is acquired. In some embodiments, the subject has autoantibodies to factor VIII or factor IX. In some embodiments, the subject treated in the methods provided herein has hemophilia, and a single subcutaneous dose of the modified FVIIa is about 60 to about 120 µg/kg, based on the weight of the treated subject. In some embodiments, a single subcutaneous dose of the modified FVIIa is about 60 µg/kg, based on the weight of the treated subject. In some embodiments, a single subcutaneous dose of the modified FVIIa is about 120 µg/kg, based on the weight of the treated subject. In some embodiments, the subject has Factor VII deficiency. In some embodiments, the subject has Factor VII deficiency and a single subcutaneous dose of the modified FVIIa is about 10 to about 20 µg/kg, based on the weight of the treated subject.

In some embodiments, the subject has been receiving oral anticoagulant therapy. In some embodiments, the oral anticoagulant therapy comprises one or more of heparin, dabigatran, rivaroxaban, apixaban, bemiparin, nadroparin, reviparin, enoxaparin, parnaparin, certoparin, dalteparin, and tinzaparin.

In some embodiments, the modified FVIIa has a potency greater than the FVIIa of SEQ ID NO: 3. In some embodiments, the modified FVIIa has increased coagulant activity in the presence of tissue factor. In some embodiments, the modified FVIIa has kcat/km in a tissue-factor dependent assay that is greater than 100%, 150%, 200%, or 250% or more than unmodified FVIIa (SEQ ID NO: 3) in the same assay. In some embodiments, the modified FVIIa has coagulation activity that is at least 1.5 times the activity of unmodified FVIIa of SEQ ID NO: 3 in the same assay. In some embodiments, the modified FVIIa has potency at least 3, or 4, or 5 times that of the unmodified FVIIa of SEQ ID NO: 3. In some embodiments, the FVIIa has increased potency as assessed by activated partial thromboplastin time (aPTT) and/or thromboelastography (TEG) or any assay that assesses thrombin generation. In some embodiments, coagulation activity of the modified FVIIa polypeptide is at least 110%, 150%, 200%, 250%, 300%, 400%, 500% or more of the coagulation activity of the unmodified FVIIa polypeptide of SEQ ID NO: 3. In some embodiments, the modified FVIIa has increased serum half-life or an increased terminal elimination half-life compared to the unmodified FVIIa. In some embodiments, the modified FVIIa has greater coagulation activity or potency than the unmodified FVIIa that has the primary amino acid sequence set forth in SEQ ID NO: 3. In some embodiments, the modified FVIIa polypeptide, when in an activated form, exhibits procoagulant activity. In some embodiments, the procoagulant activity is greater than procoagulant activity of a FVIIa polypeptide having the primary amino acid sequence set forth in SEQ ID NO: 3.

In some embodiments, the modified FVIIa polypeptide is two-chain activated Factor VII (FVIIa) polypeptide consisting of the amino acid sequence of SEQ ID NO: 280 cleaved between the arginine at position 152 and the isoleucine at position 153. In some embodiments, the modified FVIIa polypeptide is two-chain activated Factor VII (FVIIa) polypeptide consisting of the amino acid sequence of SEQ ID NO: 138 cleaved between the arginine at position 152 and the isoleucine at position 153. In some embodiments, the first and second chains are linked by a least one disulfide bridge. In some embodiments, the modified FVIIa polypeptide has at least 90% amino acid sequence identity to SEQ ID NO: 280, wherein the amino acids corresponding to positions 128, 129, 286 and 298 of SEQ ID NO: 280 are invariant. In some embodiments, the first and second chains of the two-chain polypeptide consist respectively of amino acids 1-152 and 153-406 of SEQ ID NO: 280.

In some embodiments, the modified FVIIa polypeptide comprises one or more amino acid modification(s) that increases resistance to antithrombin-III, increases binding and/or affinity to phospholipids, increases affinity for tissue factor, increases intrinsic activity, increases TF-dependent activity, increases coagulant activity, alters the conformation of the polypeptide to alter zymogenicity, increases catalytic or coagulant activity by shifting the equilibrium between highly active and less active FVIIa conformations in favor of the highly active conformations, increases resistance to proteases, decreases glycosylation, increases glycosylation, reduces immunogenicity, increases stability, and/or facilitates chemical group linkage. In some embodiments, the primary sequence of the unmodified FVIIa polypeptide consists of the sequence of amino acids set forth in SEQ ID NO: 3. In some embodiments, the modified FVIIa polypeptide is post-translationally modified. In some embodiments, the post-translational modification comprises glycosylation. In some embodiments, a post-translational modification is O-linked glycosylation. In some embodiments, a post-translational modification is N-linked glycosylation. In some embodiments, a post-translational modification is carboxylation of glutamic acid to γ-carboxyglutamic acid. In some embodiments, a post-translational modification is hydroxylation of aspartic acid to β-hydroxyaspartic acid. In some embodiments, the modification(s) of the FVIIa polypeptide is/are an amino acid replacement, insertion, deletion, or combinations thereof.

In some embodiments, the subcutaneous administration of the modified FVIIa has increased terminal elimination half-life compared to an intravenous administration of the modified FVIIa.

In some embodiments, a dose of the modified FVIIa is administered in a multiple dosing regimen. In some embodiments, the multiple dosing regimen comprises at least two or at least three doses within about 24 hours. In some embodiments, at least one dose of the multiple dosing regimen comprises about 30, about 60, about 90, or about 120 µg/kg of body weight of the subject. In some embodiments, each dose of the multiple dosing regimen is identical. In some embodiments, each dose of the multiple dosing regimen occurs about 2 to about 6 hours apart for a predetermined time period. In some embodiments, the predetermined time period is about 24 hours. In some embodiments, the multiple dosing regimen comprises a maximum of 3 doses within about 24 hours. In some embodiments, each dose of the multiple dosing regimen is 60 µg/kg based on the weight of the treated subject. In some embodiments, the multiple dosing regimen is administered as an ascending dosing regimen. In some embodiments, at least one dose of the modified FVIIa is administered intravenously prior the subcutaneous administration. In some embodiments, any single dose of the modified FVIIa is administered as a split dose at two different anatomical sites of the subject. In some embodiments, any single dose of the modified FVIIa is administered as a split dose at a single anatomical site of the subject. In some embodiments, any single dose of the modified FVIIa is about 2 to about 6 mg in amount. In some embodiments, the subject is an adult, an adolescent, a child, or an infant.

In some embodiments, the modified FVIIa is administered as a monotherapy.

In some embodiments, the subcutaneous administration of the modified FVIIa has an activity or potency greater than an intravenous administration of the modified FVIIa polypeptide. In some embodiments, the subcutaneous administration of the modified FVIIa has an activity or potency greater than an intravenous administration of an FVIIa polypeptide that is unmodified. In some embodiments, the subcutaneous administration of the modified FVIIa has an activity or potency greater than a subcutaneous administration of an FVIIa polypeptide that is unmodified. In some embodiments, the activity or potency is bioavailability and/or pharmacokinetic profiles of the modified FVIIa.

In another aspect, pharmaceutical compositions for a single dosage subcutaneous administration are provided, comprising a single therapeutically effective dose of a modified FVIIa in a pharmaceutically acceptable carrier for subcutaneous administration for an on-demand treatment of a bleed; wherein the modified FVIIa comprises modifications at least at a position corresponding to position 286 and at a position corresponding to position 298 in a FVII polypeptide comprising the sequence of amino acids set forth in SEQ ID NO: 3 or in a corresponding residue in a FVII polypeptide, wherein: the modification at position 286 is an amino acid replacement with Arg (R); the modification at position 298 is an amino acid replacement with Gln (Q); and the modified FVIIa has increased activity or potency.

In another aspect, provided herein are methods for administering modified FVII polypeptides by expression of encoding nucleic acid molecules. In some embodiments, the methods include administration of recombinant vectors. In another aspect, provided herein are modified FVII polypeptides for use in ex vivo gene expression therapy using non-viral vectors. In some embodiments, cells are engineered to express a modified FVII polypeptide, such as by integrating a modified FVII polypeptide encoding-nucleic acid into a genomic location, either operatively linked to regulatory sequences or such that it is placed operatively linked to regulatory sequences in a genomic location. In some embodiments, such cells are then administered locally or systemically to a subject, such as a patient in need of treatment.

BRIEF DESCRIPTION OF THE DRAWINGS

FIG. 1 depicts the coagulation cascade. The figure shows the intrinsic pathway and the extrinsic pathway of coagulation for the independent production of FXa and convergence of the pathways to a common pathway to generate thrombin and fibrin for the formation of a clot.

FIG. 2 depicts the cell-based model of coagulation (see e.g. Hoffman et al. (2001) Thromb Haemost 85:958-965). The figure depicts the coagulation events as being separated into three phases, initiation, amplification, and propagation.

FIG. 3 depicts the mechanisms by which FVIIa can initiate thrombin formation. The figure illustrates both the TF-dependent pathway and the TF-independent pathway of FVIIa mediated thrombin generation.

FIG. 4A is a diagram illustrating an exemplary study design for an acute injury model with subcutaneous (SQ) dosing of a modified FVIIa of the disclosure before injury in hemophilia A mice.

FIG. 4B is a diagram illustrating an exemplary study design for an acute injury model with subcutaneous dosing of a modified FVIIa of the disclosure after injury in hemophilia A mice.

FIGS. 10-12 depict the plasma concentrations of two modified FVIIa polypeptides, T128N/P129A/Q286R/M298Q FVIIa and Q286R/M298Q FVIIa, and wild type recombinant FVIIa (rFVIIa), respectively, following subcutaneous injection of the polypeptides to mice. These figures show that the T128N/P129A/Q286R/M298Q FVIIa stayed in the body longer than the other molecules.

FIG. 13 depicts the plasma concentration of following intravenous bolus injection of a T128N/P129A/Q286R/M298Q FVIIa polypeptide to mice. The terminal elimination half-life of the T128N/P129A/Q286R/M298Q FVIIa molecule was shown to be faster after intravenous injection than after subcutaneous injection.

FIG. 15A depicts the results of clinical trial simulations in a 70 kg adult, using three different subcutaneous T128N/P129A/Q286R/M298Q FVIIa treatment regimens. These results indicate that a multiple dosing regimen of 60 μg/kg is an option for treating bleeding disorders.

FIGS. 20A-20E depict the TEG traces measured from hemophilic dog W03 before and after subcutaneous treatment with the T128N/P129A/Q286R/M298Q FVIIa polypeptide.

FIGS. 21A-21J depict the TEG traces measured from hemophilic dog R11 before and after subcutaneous treatment with the T128N/P129A/Q286R/M298Q FVIIa polypeptide.

FIGS. 21K-21M depict TEG traces measured from hemophilic dog R11 after intravenous treatment with the T128N/P129A/Q286R/M298Q FVIIa polypeptide.

FIGS. 22A-22T depict the TEG traces measured from hemophilic dog R04 before and after subcutaneous treatment with the T128N/P129A/Q286R/M298Q FVIIa polypeptide.

FIGS. 23A-23P depict the TEG traces measured from hemophilic dog W64 before and after subcutaneous treatment with the T128N/P129A/Q286R/M298Q FVIIa polypeptide.

FIGS. 24A-24F depict the TEG traces measured from hemophilic dog V30 before and after subcutaneous treatment with the T128N/P129A/Q286R/M298Q FVIIa polypeptide.

DETAILED DESCRIPTION

Figure 5:
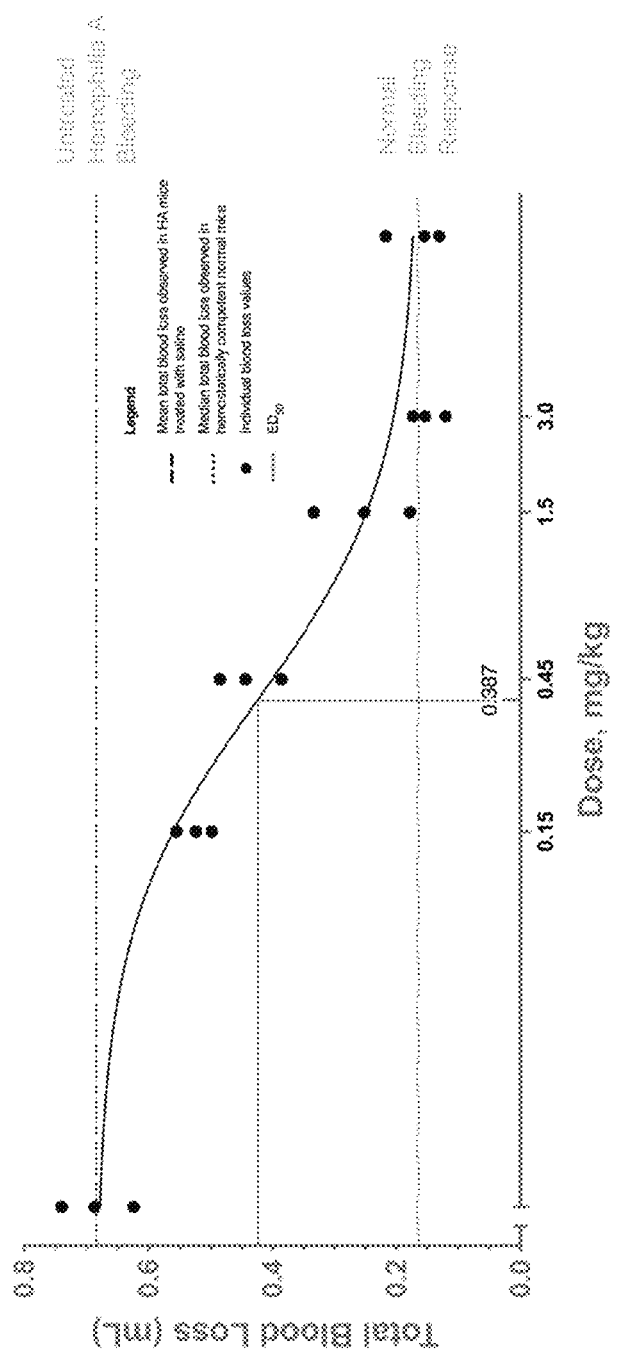
FIG. 5 is a graph depicting the results of a study using subcutaneous administration of a modified FVIIa 15 minutes before injury.

Provided herein are variant FVII (unactive) and FVIIa polypeptides (activated), also referred to herein as modified FVII polypeptides, and modified FVIIa polypeptides, respectively. Upon activation, the modified FVIIa polypeptides provided herein surprisingly offer advantages when administered subcutaneously, resulting in a decrease in the amount of administered FVIIa that is required to maintain a sufficient concentration of active FVII in the serum for hemostasis. This can lead to, for example, lower doses and/or dosage frequency necessary to achieve comparable biological effects, higher comfort and acceptance by subjects, and attenuation of secondary effects. The modified FVIIa polypeptides provided herein also surprisingly exhibit an increased terminal elimination half-life when administered subcutaneously versus when administered intravenously.

In exemplary embodiments further described herein, modified FVIIa polypeptides provided herein exhibit improved pharmacokinetic properties when administered subcutaneously. Of particular note, it is surprising and unexpected that subcutaneous administration of the modified FVIIa polypeptide exhibits desirable effects, including but not limited to, increased potency, coagulation activity, bioavailability, and extended duration and prolonged exposure, at doses lower than would have been expected. An exemplary modified polypeptide of the disclosure that exhibits improved pharmacokinetic properties (upon activation) comprises the substitutions Q286R/M298Q or comprises the substitutions T128N/P129A/Q286R/M298Q, in a FVII polypeptide having the sequence of amino acids set forth in SEQ ID NO: 3; in some embodiments, this exemplary modified FVII or modified FVIIa polypeptide comprising the substitutions T128N/P129A/Q286R/M298Q can comprise the amino acid sequence as set forth in SEQ ID NO: 280, and may be provided in an unactivate form, or in an activated form.

The modified polypeptides of the disclosure are provided for use for on-demand treatment of a bleeding event by subcutaneous administration. These modified FVIIa polypeptides may exhibit increased coagulation activity upon activation, increased potency, increased bioavailability, increased catalytic activity for FX activation in the presence and absence of tissue factor (TF), and the like. Also provided herein are methods of treatment, and dosing regimens for subcutaneous administration using such modified FVIIa polypeptides.

It is to be noted that as used herein, Factor VII (FVII, F7; also referred to as Factor 7, coagulation factor VII, serum factor VII, serum prothrombin conversion accelerator, SPCA, proconvertin and eptacog alpha) refers to a serine protease that is part of the coagulation cascade. FVII includes a Gla domain, two EGF domains (EGF-1 and EGF-2), and a serine protease domain (or peptidase S1 domain) that is highly conserved among all members of the peptidase S1 family of serine proteases, such as for example with chymotrypsin. The sequence of an exemplary precursor FVII having a signal peptide and propeptide is set forth in SEQ ID NO: 1. An exemplary mature FVII polypeptide (human mature FVII) is set forth in SEQ ID NO: 3. Full activation of FVII, which occurs upon conformational change from a zymogen-like form, occurs upon binding to its co-factor, tissue factor (TF). Also, mutations can be introduced into the FVII that result in the conformation change in the absence of tissue factor.

As discussed above, Factor VII can be found endogenously as a single-chain form, and activated FVIIa can be found as a two-chain form thereof, including zymogen-like and fully activated two-chain forms. Reference to FVII polypeptide and FVIIa polypeptide can also include precursor polypeptides and mature FVII polypeptides in single-chain or two-chain forms, truncated forms thereof that have anti-coagulant activity, and includes allelic variants and species variants, variants encoded by splice variants, and other variants, including polypeptides that have at least 40%, 45%, 50%, 55%, 65%, 70%, 75%, 80%, 85%, 90%, 95%, 96%, 97%, 98%, 99% or more sequence identity to the precursor polypeptide set forth in SEQ ID NO: 1 or the mature form SEQ ID NO: 3 thereof.

In exemplary embodiments, included are modified FVIIa polypeptides, such as those of SEQ ID NOS: 138 and 280 and variants thereof. Also included are those modified polypeptides that retain at least one activity of a FVIIa, such as TF binding, factor X binding, phospholipid binding, and/or coagulant activity. By retaining activity, the activity can be altered, such as reduced or increased, as compared to a wild-type FVIIa so long as the level of activity retained is sufficient to yield a detectable effect. FVIIa polypeptides include, but are not limited to, tissue-specific isoforms and allelic variants thereof, synthetic molecules prepared by translation of nucleic acids, proteins generated by chemical synthesis, such as syntheses that include ligation of shorter polypeptides, through recombinant methods, proteins isolated from human and non-human tissue and cells, chimeric FVII polypeptides and modified forms thereof. Modified FVIIa polypeptides also include fragments or portions of FVII that are of sufficient length or include appropriate regions to retain at least one activity (upon activation if needed) of a full-length mature polypeptide. Modified FVIIa polypeptides also include those that contain further modifications, such as chemical or posttranslational modifications and those that do not contain chemical or posttranslational modifications. Such modifications include, but are not limited to, PEGylation, albumination, glycosylation, farnysylation, carboxylation, hydroxylation, phosphorylation, and other polypeptide modifications known in the art.

As used herein, potency refers to the activity of the FVIIa in vitro, ex vivor, or in vivo, such as in an animal model or in a human. See, e.g., the Examples. For example, as exemplified about 10 μg of modified FVIIa of SEQ ID NO: 280 has the same in vivo activity in stopping bleeds as about 50 μg of the unmodified FVIIa (SEQ ID NO: 3, or NovoSeven® FVIIa), when each are administered subcutaneously. In exemplary embodiments, a modified FVIIa has a potency about 5-fold greater than the unmodified FVIIa.

It is understood that the activity exhibited or retained by a modified FVIIa polypeptide can be any activity, including, but not limited to, coagulation or coagulant activity, procoagulant activity; proteolytic or catalytic activity such as to effect factor X (FX) activation or Factor IX (FIX) activation; antigenicity (ability to bind to or compete with a polypeptide for binding to an anti-FVII antibody); ability to bind tissue factor, factor X or factor IX, or bind activated platelets; and/or ability to bind to phospholipids. In some instances, a modified FVIIa polypeptide can possess an activity that is increased compared to an unmodified FVIIa polypeptide. In some cases, a modified FVIIa polypeptide can possess an activity that is decreased compared to an unmodified FVIIa polypeptide. Activity of a modified FVIIa polypeptide can be any level of percentage of activity of the unmodified polypeptide, where both polypeptides are in the same form, including but not limited to, 1% of the activity, 2%, 3%, 4%, 5%, 10%, 20%, 30%, 40%, 50%, 60%, 70%, 80%, 90%, 95%, 96%, 97%, 98%, 99%, 100%, 200%, 300%, 400%, 500%, or more activity compared to the polypeptide that does not contain the modification at issue. For example, a modified FVIIa polypeptide can exhibit increased or decreased activity compared to the unmodified FVIIa polypeptide in the same form. For example, it can retain at least about or 1%, 2%, 3%, 4%, 5%, 6%, 7%, 8%, 9%, 10%, 20%, 30%, 40%, 50%, 60%, 70%, 80%, 90%, 95%, 96%, 97%, 98% or at least 99% of the activity of the unmodified FVIIa polypeptide. In other embodiments, the change in activity is at least about 2 times, 3 times, 4 times, 5 times, 6 times, 7 times, 8 times, 9 times, 10 times, 20 times, 30 times, 40 times, 50 times, 60 times, 70 times, 80 times, 90 times, 100 times, 200 times, 300 times, 400 times, 500 times, 600 times, 700 times, 800 times, 900 times, 1000 times, or more times greater than unmodified FVII. The particular level to be retained is a function of the intended use of the polypeptide and can be empirically determined. Activity can be measured, for example, using in vitro or in vivo assays such as those described herein or in the Examples below.

As used herein, "coagulation activity" or "coagulant activity" or "pro-coagulant activity" refers to the ability of a polypeptide to effect coagulation. Assays to assess coagulant activity are known to those of skill in the art, and include, but are not limited to, the prothromboplastin time (PT) assay or the activated partial thromboplastin time (aPTT) assay.

As used herein, "on-demand" treatment includes: (1) treatment administered to a subject who is bleeding, (2) on-demand prophylactic treatment (e.g., provided in an anticipatory manner) administered to a subject who is not bleeding but who is likely to start to bleed (e.g. treatment prior to medical treatment/surgery) or expecting to otherwise engage in an activity or be in a situation that may cause the subject to bleed (e.g. a heavy physical activity that oftens leads to injury, e.g. competitive sports), (3) treatment to a subject before the clinical observation of a bleed, and (4) treatment to a subject using a pre-determined regimen after bleeding starts. With respect to (3), there are instances when a subject can feel a bleed before it can be observed clinically, e.g., when they have joint bleeding episodes; thus, the bleed can be treated before it is observed. In exemplary embodiments provided herein, modified FVIIa polypeptides are administered subcutaneously on-demand to prevent or reduce bleeding, and can be administered on a dosing schedule or regimen.

It should be understood that an "on-demand prophylactic treatment," which can be provided in an anticipatory manner, includes treatment provided to a subject expected to experience a bleed, or to a subject likely to experience a bleed. In some embodiments, an on-demand prophylactic treatment is provided to a subject as determined to be needed by the subject. In exemplary embodiments provided herein, any of the modified FVIIa polypeptides provided herein are administered subcutaneously on-demand prophylactically, in an anticipatory manner to a subject that is expecting to engage in an activity or be in a situation that may cause the subject to bleed. For example, any of the modified FVIIa polypeptides provided herein may be administered to a subject that is about to engage in physical activity, such as, but not limited to, exercise, sports, manual labor, and any other activity having an elevated risk of injury. In exemplary embodiments provided herein, any of the modified FVIIa polypeptides provided herein are administered subcutaneously on-demand prophylactically, in an anticipatory manner to a subject that is expecting to experience a bleed, such as a bleed due to, but not limited to, a surgery, or a dental procedure (e.g., tooth extraction, regular tooth and/or gum cleaning).

As contemplated herein, a prophylactic treatment or prophylaxis that is not an on-demand prophylactic treatment is a treatment that is be provided in a continuous and consistent manner, can include treatment provided to a subject who can experience uncontrolled or spontaneous bleeds, or a subject who can experience prolonged bleeding as a result of an injury or a spontaneous bleed. Such a prophylactic treatment can be provided to a subject in a regular, continuous, and consistent regimen. Such a regimen can include, for example, a weekly or daily regular dose.

As used herein, "modified factor VII polypeptides" and "modified factor VII" (that give rise to the activated modified FVIIa polypeptides of the disclosure) refer to a FVII polypeptide that has one or more amino acid differences compared to an unmodified factor VII polypeptide, and which can be in an unactivated or an activated form. The one or more amino acid differences can be amino acid mutations such as one or more amino acid replacements (substitutions), insertions or deletions, or can be insertions or deletions of entire domains, and any combinations thereof. For example, a modified FVII polypeptide provided herein can have 1, 2, 3, 4, 5, 6, 7, 8, 9, 10, 11, 12, 13, 14, 15, 16, 17, 18, 19, 20, 30, 40, 50 or more amino acid differences compared to an unmodified FVII polypeptide. Any modification is contemplated as long as the resulting polypeptide exhibits at least one FVII activity associated with a native FVIIa polypeptide, such as, for example, coagulation or coagulant activity, pro-coagulant activity; proteolytic or catalytic activity such as to effect factor X (FX) activation or Factor IX (FIX) activation; antigenicity (ability to bind to or compete with a polypeptide for binding to an anti-FVII antibody); ability to bind tissue factor, factor X or factor IX, or activated platelets; and/or ability to bind to phospholipids. Exemplary modified FVII polypeptides are described in PCT Publication No. WO2009126307A2, which is incorporated by reference in its entirety.

As used herein, "inhibitors of coagulation" refer to proteins or molecules that act to inhibit or prevent coagulation or clot formation. The inhibition or prevention of coagulation can be observed in vivo or in vitro, and can be assayed using any method known in the art including, but not limited to, prothromboplastin time (PT) assay or the activated partial thromboplastin time (aPTT) assay.

As used herein, tissue factor pathway inhibitor (TFPI, also referred to as TFPI-1) is a Kunitz-type inhibitor that is involved in the formation of a quaternary TF/FVIIa/TFPI/FXa inhibitory complex in which the activity of FVIIa is inhibited. TFPI is expressed as two different precursor forms following alternative splicing, TFPIα (SEQ ID NO:75) and TFPIβ (SEQ ID NO:77) precursors, which are cleaved during secretion to generate a 276 amino acid (SEQ ID NO:76) and a 223 amino acid (SEQ ID NO:78) mature protein, respectively. TFPI contains 3 Kunitz domains, of which the Kunitz-1 domain is responsible for binding and inhibition of FVIIa.

As used herein, the terms "patient" or "subject" refer to any vertebrate including, without limitation, humans and other primates (e.g., chimpanzees, cynomologous monkeys, and other apes and monkey species), farm animals (e.g., cattle, sheep, pigs, goats and horses), domestic mammals (e.g., dogs and cats), laboratory animals (e.g., rabbits, rodents such as mice, rats, and guinea pigs), and birds (e.g., domestic, wild and game birds such as chickens, turkeys and other gallinaceous birds, ducks, geese, and the like). In some embodiments, the subject is a mammal. In exemplary embodiments, the subject is a human.

Modified FVII and FVIIa Polypeptides

For purposes of clarity, provided herein are modified FVII polypeptide compositions of matter and modified FVIIa polypeptide compositions of matter. The subcutaneously administered on-demand treatment embodiments described herein contemplate the administration of the modified FVIIa polypeptides of the disclosure (administration of the activated form). Accordingly, when treatments are discussed herein, reference is made to the modified FVIIa polypeptides of the disclosure.

Provided herein are modified FVIIa polypeptides that are designed to exhibit increased activity or potency, e.g. increased bioavailability and coagulation activity, and that can serve as improved therapeutics to treat diseases and conditions amenable to Factor VII therapy, such as by subcutaneous on-demand administration.

Such modified FVIIa polypeptides can be used in the on-demand treatment of bleeding disorders or events, such as hemophilias or injury, where FVIIa polypeptides can function to promote blood coagulation and reduce/stop bleeding. In some embodiments, modified FVIIa polypeptides provided herein can be used in hemophiliac patients having autoantibodies to FVIIIa and FIXa. The modified FVIIa polypeptides provided herein offer advantages including a decrease in the amount of administered FVIIa that is required to maintain a sufficient concentration of active FVIIa in the serum for hemostasis. This can lead to, for example, lower doses and/or dosage frequency necessary to achieve comparable biological effects, higher comfort and acceptance by subjects, and attenuation of secondary effects. In other embodiments, modified FVIIa polypeptides provided herein show an increased terminal elimination half-life when administered subcutaneously as compared to when administered intravenously.

Turning to the modifications, they can be made to any form of a FVII polypeptide, including allelic and species variants, splice variants, variants known in the art, or hybrid or chimeric FVII molecules. For example, the modifications provided herein can be made in a precursor FVII polypeptide set forth in SEQ ID NOS:1 or 2, a mature FVII polypeptide set forth in SEQ ID NO: 3, or any species, allelic or modified variants and active fragments thereof, that has 40%, 50%, 60%, 70%, 80%, 90%, 91%, 92%, 93%, 94%, 95%, 96%, 97%, 98%, or 99% sequence identity to any of the FVII polypeptides set forth in SEQ ID NOS: 1-3.

Modifications provided herein of a starting, unmodified reference polypeptide include amino acid replacements or substitution, additions or deletions of amino acids, or any combination thereof. For example, modified FVII polypeptides include those with 1, 2, 3, 4, 5, 6, 7, 8, 9, 10, 11, 12, 13, 14, 15, 16, 17, 18, 19, 20, 30, 40, 50 or more modified positions. Also provided herein are modified FVII polypeptides with two or more modifications compared to a starting reference FVII polypeptide. In some embodiments, the modified FVII polypeptides include two modifications, or four modifications.

Any modification provided herein can be combined with any other modification known to one of skill in the art so long as the resulting modified FVIIa polypeptide exhibits increased coagulation activity when it is in its two-chain form. Typically, the modified FVIIa polypeptides exhibit increased coagulant activity. The activities or properties that can be altered as a result of modification include, but are not limited to, coagulation or coagulant activity; pro-coagulant activity; proteolytic or catalytic activity such as to effect factor X (FX) activation or Factor IX (FIX) activation; antigenicity (ability to bind to or compete with a polypeptide for binding to an anti-FVII antibody); ability to bind tissue factor, tissue factor inhibitory factor (TFPI), antithrombin III, factor X or factor IX; ability to bind to phospholipids, serum albumin or platelet integrin $\alpha_{IIb}\beta_3$; serum half-life; three-dimensional structure; pI; and/or conformation. Included among the modified FVIIa polypeptides provided herein are those that have increased resistance to antithrombin III (AT-III), increased catalytic activity in the presence and/or absence of TF, increased resistance to tissue factor pathway inhibitor (TFPI), increased resistance to the inhibitory effects of $Zn^{2+}$, improved pharmacokinetic properties, such as increased serum half-life, increased intrinsic activity, altered glycosylation, increased affinity and/or binding for serum albumin, increased affinity and/or binding for platelet integrin $\alpha_{IIb}\beta_3$, and/or increased affinity and/or binding for activated platelets.

In some examples, a modification can affect two or more properties or activities of a FVIIa polypeptide. For example, a modification can result in increased procoagulant activity and increased potency of the modified FVIIa polypeptide compared to an unmodified FVIIa polypeptide. Modified FVIIa polypeptides provided herein can be assayed for each property and activity to identify the range of effects of a modification. Such assays are known in the art.

The resulting modified FVII polypeptides include those that are single-chain zymogen polypeptide or those that result in two-chain zymogen-like polypeptides. For example, any modified polypeptide provided herein that is a single-chain polypeptide can be autoactivated or activated by other coagulation factors to generate a modified two-chain form (i.e. FVIIa). The activities of a modified FVIIa polypeptide are typically exhibited in its two-chain form.

Hence, by virtue of the modifications provided herein, the modified FVIIa polypeptides can exhibit increased coagulant activity, increased duration of coagulant activity, and/or an enhanced therapeutic index. This can be observed in a TF-dependent and/or TF-independent manner. Typically, the increased coagulant activity, increased duration of coagulant activity, and/or an enhanced therapeutic index of the modified FVIIa polypeptides provided herein can be observed in vitro or ex vivo in appropriate assays, or in vivo, such as upon administration to a subject, such as a human or non-human subject. The increased activity of the modified FVIIa polypeptides can be increased by at least or about 1%, 2%, 3%, 4%, 5%, 6%, 7%, 8%, 9%, 10%, 20%, 30%, 40%, 50%, 60%, 70%, 80%, 90%, 100%, 110%, 120%, 130%, 140%, 150%, 160%, 170%, 180%, 190%, 200%, 300%, 400%, 500%, or more compared to the activity of the starting or unmodified FVIIa polypeptide.

Exemplary Modifications to a FVIIa Polypeptide to Increase Catalytic Activity

Provided herein are modified FVIIa polypeptides that, among other things, exhibit increased coagulant activity. Without being bound to any theory or mechanism, in some embodiments, such FVIIa polypeptides can be generated by amino acid substitution of one or more residues that can affect the conformation of the oxyanion hole. The introduction of different amino acid residues at particular positions (e.g., position 143 by chymotrypsin numbering, or 286 by mature FVII numbering) can alter the conformation of the modified FVIIa polypeptide such that the oxyanion hole is more effective during catalysis. This can result in a modified FVIIa polypeptide with increased catalytic activity compared to an unmodified FVIIa polypeptide. Changes in catalytic activity due to mutations affecting the oxyanion hole can manifest as increased coagulant activity. Increases in catalytic and coagulant activity of the modified FVIIa polypeptides provided herein can be observed in the presence and/or absence of tissue factor (i.e. can be TF-dependent and/or TF-independent). Thus, when evaluated in an appropriate in vitro, in vivo, or ex vivo assay such as following administration to a subject as a pro-coagulant therapeutic, the modified FVIIa polypeptides can display increased coagulant activity compared with that of the unmodified FVIIa polypeptides.

The conformation of the oxyanion hole can be altered to induce a more effective conformation by modification of one or more amino acid residues that are involved in the formation of, or are in proximity to, the oxyanion hole. As provided herein, exemplary of such amino acid residues is Q286 (numbering corresponding a mature FVII polypeptide set forth in SEQ ID NO: 3), which corresponds to Q143 by chymotrypsin numbering. Q286 can be modified by, for example, amino acid substitution, deletion or insertion. When the modification is effected by amino acid substitution, the glutamine residue at position 286 can be replaced with any other amino acid residue.

Q286 is located adjacent to and in contact with residues that form regions of the active site and active site cleft of the FVIIa polypeptide. As such, it has been stated that modification at this position should result in reduced catalytic activity (see e.g., U.S. Pat. No. 6,806,063). This has been demonstrated in previous studies (see, e.g., International Pat. Pub. No. WO2007031559), where the glutamine residue was replaced with an alanine (Q286A). The resulting modified FVIIa polypeptide exhibits a reduced ability to activate Factor X compared with the wild-type polypeptide. In other studies, the same mutation had essentially no effect on catalytic activity of the FVIIa mutant for Factor X (Dickinson et al., (1996) Proc. Nat. Acad. Sci. USA. 93:14379-14384) or a synthetic substrate (International Pat. Pub. No. WO2007031559).

As demonstrated herein (see Examples), however, modification of the FVII polypeptide at position 286 (numbering corresponding a mature FVII polypeptide set forth in SEQ ID NO: 3; corresponding to position 143 by chymotrypsin numbering), particularly with a basic residue, such as arginine (Arg, R), results in a modified FVIIa polypeptide with increased catalytic and coagulant activity. In some embodiments, a FVIIa polypeptide comprising a modification at position 286 with an arginine residue results in a modified FVIIa polypeptide showing efficacy for an on-demand treatment by subcutaneous, e.g. administration of a bleed after onset of the bleed. In some embodiments, the subcutaneous administration is about one minute after onset of the bleed. In some embodiments, the subcutaneous administration is provided in a lower dose than a dose required for subcutaneous administration a FVIIa polypeptide that is unmodified. In some embodiments, the subcutaneous administration is provided in a lower dose than a dose required for intravenous administration a FVIIa polypeptide that is unmodified.

Thus, provided herein are modified FVII polypeptides that contain a modification, such as amino acid replacement with a basic amino acid, at the amino acid position corresponding to amino acid position 286 of a mature FVII polypeptide set forth in SEQ ID NO: 3 (amino acid position 143 by chymotrypsin numbering). The modifications provided herein at amino acid position 286 can be made in any FVII polypeptide, including a precursor FVII polypeptide set forth in SEQ ID NOS:1 or 2, a mature FVII polypeptide set forth in SEQ ID NO: 3, or any species, allelic or modified variants and active fragments thereof, that has 40%, 50%, 60%, 70%, 80%, 90%, 91%, 92%, 93%, 94%, 95%, 96%, 97%, 98%, or 99% sequence identity to any of the FVII polypeptides set forth in SEQ ID NOS: 1-3.

Basic Amino Acid Substitutions at Position 286

Provided are modified FVII polypeptides in which the glutamine at position 286 (numbering corresponding the mature FVII polypeptide set forth in SEQ ID NO: 3; corresponding to position 143 by chymotrypsin numbering) is replaced with a basic amino acid residue, such as any one of arginine (Arg, R), histidine (His, H) or lysine (Lys, K). In particular, provided herein are modified FVII polypeptides in which the glutamine at position 286 is replaced with an arginine (i.e. Q286R, corresponding to Q143R by chymotrypsin numbering). Modeling studies indicate that substitution of the glutamine with an arginine results in the loss of two key interactions that stabilize an inactive conformation of the FVIIa oxyanion hole in wild-type or unmodified FVII.

The increased coagulant activity of modified FVIIa polypeptides containing the amino acid substitution Q286R can be a result of an increase in catalytic activity. The increased catalytic activity can be observed in the presence and/or absence of tissue factor (TF). Thus, the increased catalytic activity can be TF-dependent and/or TF-independent. An exemplary modification of FVII is Q286R/M298Q, which is an FVIIa polypeptide comprising modifications at least at a position corresponding to position 286 and at a position corresponding to position 298 in a FVII polypeptide comprising the sequence of amino acids set forth in SEQ ID NO: 3 or in a corresponding residue in a FVII polypeptide, wherein the modification at position 286 is an amino acid replacement with Arg (R), and the modification at position 298 is an amino acid replacement with Gln (Q). This exemplary modified FVII or FVIIa polypeptide may comprise the amino acid sequence as set forth in SEQ ID NO: 138. This exemplary modified FVIIa polypeptide can exhibit increased catalytic activity for FX activation in the presence and absence of TF, and may have an activity or potency greater than the FVIIa that is unmodified. For example, such exemplary modified FVIIa polypeptides have an increased activity or potency when administered subcutaneously. In some embodiments, the subcutaneous administration of the modified FVIIa polypeptide has an activity or potency greater than an intravenous administration of the modified FVIIa polypeptide. In some embodiments, the subcutaneous administration of the modified FVIIa has an activity or potency greater than an intravenous administration of an FVIIa polypeptide that is unmodified. In some embodiments, the subcutaneous administration of the modified FVIIa has an activity or potency greater than a subcutaneous administration of an FVIIa polypeptide that is unmodified.

Altered Glycosylation and Exemplary Modifications to Alter Glycosylation

The properties and activities of a protein can be altered by modulating the extent, level, and/or type of glycosylation. For example, glycosylation can increase serum-half-life of polypeptides by increasing the stability, solubility, and reducing the immunogenicity of a protein. Glycosylation can increase the stability of proteins by reducing the proteolysis of the protein and can protect the protein from thermal degradation, exposure to denaturing agents, damage by oxygen free radicals, and changes in pH. Glycosylation also can allow the target protein to evade clearance mechanisms that can involve binding to other proteins, including cell surface receptors. Carbohydrate moieties that contain sialic acid can affect the solubility of a protein. The sialic acid moieties are highly hydrophilic and can shield hydrophobic residues of the target protein. This decreases aggregation and precipitation of the target protein. Decreased aggregation also aids in the prevention of the immune response against the target protein. Carbohydrates can furthermore shield immunogenic sequences from the immune system. The volume of space occupied by the carbohydrate moieties can decrease the available surface area that is surveyed by the immune system. These properties lead to the reduction in immunogenicity of the target protein.

Provided herein are FVII polypeptides that have been modified by altering the level and/or type of glycosylation as compared to an unmodified FVII polypeptide. Glycosylation can be increased or decreased compared to the unmodified FVII. In some instances, the level of glycosylation is increased, resulting in a hyperglycosylated FVII polypeptide. This can be achieved, for example, by incorporation of at least one non-native glycosylation site not found in the unmodified FVII polypeptide to which a carbohydrate moiety is linked. Hyperglycosylated FVII polypeptides also can be generated by linkage of a carbohydrate moiety to at least one native glycosylation site found but not glycosylated in the unmodified FVII polypeptide. In other examples, the level of glycosylation in a modified FVII polypeptide is decreased compared to an unmodified FVII polypeptide. This can be achieved by eliminating one or more native glycosylation sites, such as by amino acid replacement or deletion.

Alteration of the extent, level and/or type of glycosylation of a protein has been described in the art as a means to reduce immunogenicity, increase stability, reduce the frequency of administration and/or reduce adverse side effects such as inflammation. Normally, this is effected by increasing the glycosylation levels. The glycosylation site(s) provides a site for attachment for a carbohydrate moiety on the polypeptide, such that when the polypeptide is produced in a eukaryotic cell capable of glycosylation, it is glycosylated.

Without being bound to theory or mechanism, there are four native glycosylation sites in FVII; two N-glycosylation sites at N145 and N322, and two O-glycosylation sites at S52 and S60, corresponding to amino acid positions in the mature FVII polypeptide set forth in SEQ ID NO: 3.

A FVII polypeptide can be modified at one or more positions to alter glycosylation of the polypeptide. The modified FVII polypeptides provided herein that have altered glycosylation compared to an unmodified FVII polypeptide can have no glycosylation, O-linked glycosylation, N-linked glycosylation, and/or a combination thereof. In some examples, a modified FVII polypeptide includes 1, 2, 3, 4, 5 or more carbohydrate moieties, each linked to different glycosylation sites. The glycosylation sites can be a native glycosylation site and/or a non-native glycosylation site. In some examples, the modified FVII polypeptide is glycosylated at more than one non-native glycosylation site. For example, a modified FVII polypeptide can be modified to introduce 1, 2, 3, 4, 5 or more non-native glycosylation sites. T128N/P129A is an example of a modification to a FVII polypeptide that alters glycosylation levels, by these two substitutions in the EGF2 domain of the light chain of FVII creating an additional N-linked glycosylation site.

In other embodiments, further modifications can be made to the amino acid sequence of the modified FVII polypeptides provided herein such that additional glycosylation sites are introduced, thus increasing the level of glycosylation of the modified FVII polypeptide as compared to an unmodified FVII polypeptide. The glycosylation site can be an N-linked or O-linked glycosylation site. Examples of modifications that can be made to a FVII polypeptide that introduce one or more new glycosylation sites include, but are not limited to, those that are described in US6806063 and WO200393465. Exemplary modifications described that can result in increased glycosylation of the modified FVII polypeptide as compared to an unmodified FVII polypeptide include, but is not limited to, T128N, and T128N/P129A. An exemplary modification of FVII is T128N/P129A, which is an FVII polypeptide comprising modifications at least at a position corresponding to position 128 and at a position corresponding to position 129 in the FVII polypeptide having the sequence of amino acids set forth in SEQ ID NO: 3, wherein, the modification at position 128 is an amino acid replacement with Asn (N), and the modification at position 129 is Ala (A). This exemplary modified FVII polypeptide has an additional N-linked glycosylation site, and may have an activity or potency greater than the FVIIa that is unmodified. In some embodiments, a modified FVIIa polypeptide having one or more additional N-linked glycosylation site than the FVIIa that is unmodified may exhibit higher or increased bioavailability than the FVIIa that is unmodified.

Modifications that Increase Resistance to TFPI

In one example, additional modifications can be made to a modified FVII polypeptide that contains a modification at amino acid position 286 by mature FVII numbering that result in increased resistance to TFPI. Such resistance to TFPI can be achieved, for example, by mutation of one or more residues in FVII involved in the interaction and binding with TFPI to reduce or prevent such binding, thereby making the modified FVIIa polypeptides resistant to the naturally inhibitory effects of TFPI with respect to coagulation initiation. For example, the modifications can be made at amino acid residues that are FVII/TFPI contact residues or residues in close proximity to the interaction surface.

Combinations and Additional Modifications

Any one or more of the modifications described above can be combined with any other modification(s) described above or described elsewhere in the art. In one example, the additional modification can be made to the FVII polypeptide sequence such that its interaction with other factors, molecules and proteins is altered. Additional modifications also can be made to a modified FVII polypeptide provided herein that alter the conformation or folding of the polypeptide. Additional modifications also can be made to the FVII polypeptide to effect post-translational modifications. For example, the polypeptide can be modified to include additional glycosylation sites such that the resulting modified FVII polypeptide has increased glycosylation compared to an unmodified FVII polypeptide. Modifications also can be made to introduce amino acid residues that can be subsequently linked to a chemical moiety, such as one that acts to increase stability of the modified FVIIa polypeptide. The stability of a FVIIa polypeptide also can be altered by modifying potential proteolytic sites, thereby increasing the resistance of the modified FVIIa polypeptide to proteases.

Exemplary of the combination modifications provided herein are those that include at least the Q286R mutation (numbering corresponding to the mature FVII polypeptide set forth in SEQ ID NO: 3; corresponding to Q143R by chymotrypsin numbering). The modified FVII polypeptides containing the Q286R modification can contain 1, 2, 3, 4, 5, 6 or more additional modifications. These additional modifications can be included to, for example, alter catalytic activity, resistance to AT-III, resistance to TFPI, resistance to inhibition by Zn2+, intrinsic activity, amidolytic activity, phospholipid binding and/or affinity, glycosylation, resistance to proteases, half-life and interaction with other factors or molecules, such as FX, FIX, serum albumin and platelet integrin αIIbβ3. Typcially, the modified FVIIa polypeptides provided herein that contain two or more modifications, wherein one modification is the amino acid substitution Q286R, exhibit increased coagulant activity compared to the wild-type FVIIa polypeptide.

In some examples, the modified FVIIa polypeptides containing two or more modifications, wherein one is Q286R, exhibit increased catalytic and coagulant activity compared to the wild type polypeptide as well as compared to a FVIIa polypeptide containing any one of the mutations alone. For example, provided herein are modified FVIIa polypeptides that contain both the Q286R and M289Q amino acid substitutions (Q286R/M298Q with numbering corresponding to the mature FVII polypeptide set forth in SEQ ID NO: 3; corresponding to Q143R/M156Q by chymotrypsin numbering). The Q286R/M298Q combination FVII modified polypeptide exhibits increased catalytic activity for its substrate, Factor X, compared to wild type FVII, the Q286R single mutant and the M298Q single mutant.

An exemplary modification of FVII having a combination of modifications is T128N/P129A/Q286R/M298Q, which is an FVIIa polypeptide comprising modifications at least at a position corresponding to position 128, at a position corresponding to position 129, at a position corresponding to position 286, and at a position corresponding to position 298 in the FVII polypeptide having the sequence of amino acids set forth in SEQ ID NO: 3, wherein the modification at position 128 is an amino acid replacement with Asn (N), the modification at position 129 is Ala (A), the modification at position 286 is an amino acid replacement with Arg (R), and the modification at position 298 is an amino acid replacement with Gln (Q). This exemplary modified FVII polypeptide has an additional N-linked glycosylation site, and when activated to FVIIa, may exhibit increased catalytic activity for FX activation in the presence and absence of TF, and may have an activity or potency greater than the FVIIa that is unmodified. This exemplary modified FVIIa polypeptide may also exhibit increased pharmacokinetic properties as compared to other modified FVIIa polypeptides, such as the modified T128N/P129A FVIIa polypeptide also described herein. Of particular note is that the M298Q mutation alone may cause the FVIIa polypeptide to become more catalytically active with respect to an unmodified FVIIa polypeptide, and thus, it would be expected to become inhibited faster by antithrombin III (AT-III). However, the T128N/P129A/Q286R/M298Q combination mutation described herein demonstrates an unexpected resistance to AT while maintaining increased activity. In some embodiments, the T128N/P129A/Q286R/M298Q combination mutation can provide a FVIIa polypeptide having increased activity or potency, such as bioavailability and/or pharmacokinetic profiles, when administered subcutaneously to a subject, with respect to an intravenous administration of the T128N/P129A/Q286R/M298Q FVIIa polypeptide. In some embodiments, the T128N/P129A/Q286R/M298Q combination mutation can provide can provide a FVIIa polypeptide having increased activity or potency, such as bioavailability and/or pharmacokinetic profiles, when administered subcutaneous to a subject, with respect to a subcutaneous and/or intravenous administration of an FVIIa that is unmodified.

Production of FVII Polypeptides

FVII polypeptides, including modified FVIIa polypeptides, or domains thereof of FVII or other vitamin-K polypeptide, can be obtained by methods well known in the art for protein purification and recombinant protein expression. Any method known to those of skill in the art for identification of nucleic acids that encode desired genes can be used. Any method available in the art can be used to obtain a full length (i.e., encompassing the entire coding region) cDNA or genomic DNA clone encoding a FVII polypeptide or other vitamin-K polypeptide, such as from a cell or tissue source, such as for example from liver. Modified FVII polypeptides can be engineered as described herein, such as by site-directed mutagenesis.

FVII can be cloned or isolated using any available methods known in the art for cloning and isolating nucleic acid molecules. Such methods include PCR amplification of nucleic acids and screening of libraries, including nucleic acid hybridization screening, antibody-based screening and activity-based screening.

Methods for amplification of nucleic acids can be used to isolate nucleic acid molecules encoding a FVII polypeptide, including for example, polymerase chain reaction (PCR) methods. A nucleic acid containing material can be used as a starting material from which a FVII-encoding nucleic acid molecule can be isolated. For example, DNA and mRNA preparations, cell extracts, tissue extracts (e.g. from liver), fluid samples (e.g. blood, serum, saliva), samples from healthy and/or diseased subjects can be used in amplification methods. Nucleic acid libraries also can be used as a source of starting material. Primers can be designed to amplify a FVII-encoding molecule. For example, primers can be designed based on expressed sequences from which a FVII is generated. Primers can be designed based on back-translation of a FVII amino acid sequence. Nucleic acid molecules generated by amplification can be sequenced and confirmed to encode a FVII polypeptide.

Additional nucleotide sequences can be joined to a FVII-encoding nucleic acid molecule, including linker sequences containing restriction endonuclease sites for the purpose of cloning the synthetic gene into a vector, for example, a protein expression vector or a vector designed for the amplification of the core protein coding DNA sequences. Furthermore, additional nucleotide sequences specifying functional DNA elements can be operatively linked to a FVII-encoding nucleic acid molecule. Examples of such sequences include, but are not limited to, promoter sequences designed to facilitate intracellular protein expression, and secretion sequences designed to facilitate protein secretion. Additional nucleotide sequences such as sequences specifying protein binding regions also can be linked to FVII-encoding nucleic acid molecules. Such regions include, but are not limited to, sequences to facilitate uptake of FVII into specific target cells, or otherwise enhance the pharmacokinetics of the synthetic gene.

The identified and isolated nucleic acids can then be inserted into an appropriate cloning vector. A large number of vector-host systems known in the art can be used. Possible vectors include, but are not limited to, plasmids or modified viruses, but the vector system must be compatible with the host cell used. Such vectors include, but are not limited to, bacteriophages such as lambda derivatives, or plasmids such as pBR322 or pUC plasmid derivatives or the Bluescript vector (Stratagene, La Jolla, Calif.). The insertion into a cloning vector can, for example, be accomplished by ligating the DNA fragment into a cloning vector which has complementary cohesive termini. Insertion can be effected using TOPO cloning vectors (Invitrogen, Carlsbad, Calif.). If the complementary restriction sites used to fragment the DNA are not present in the cloning vector, the ends of the DNA molecules can be enzymatically modified. Alternatively, any site desired can be produced by ligating nucleotide sequences (linkers) onto the DNA termini; these ligated linkers can contain specific chemically synthesized oligonucleotides encoding restriction endonuclease recognition sequences. In an alternative method, the cleaved vector and FVII protein gene can be modified by homopolymeric tailing. Recombinant molecules can be introduced into host cells via, for example, transformation, transfection, infection, electroporation and sonoporation, so that many copies of the gene sequence are generated.

In specific embodiments, transformation of host cells with recombinant DNA molecules that incorporate the isolated FVII protein gene, cDNA, or synthesized DNA sequence enables generation of multiple copies of the gene. Thus, the gene can be obtained in large quantities by growing transformants, isolating the recombinant DNA molecules from the transformants and, when necessary, retrieving the inserted gene from the isolated recombinant DNA.

Coagulation Activity

Modified FVIIa polypeptides can be tested for coagulation activity by using assays well known in the art. For example, some of the assays include, but are not limited to, a two stage clotting assay (Liebman et al., (1985) Proc. Natl. Acad. Sci. U.S.A. 82:3879-3883); the prothrombin time assay (PT, which can measure TF-dependent activity of FVIIa in the extrinsic pathway); assays which are modifications of the PT test; the activated partial thromboplastin time (aPTT, which can measure TF-independent activity of FVIIa); activated clotting time (ACT); recalcified activated clotting time; the Lee-White Clotting time; or thromboelastography (TEG) (Pusateri et al. (2005) Critical Care 9:S15-S24). For example, coagulation activity of a modified FVIIa polypeptide can be determined by a PT-based assay where FVII is diluted in FVII-deficient plasma, and mixed with prothrombin time reagent (recombinant TF with phospholipids and calcium), such as that available as Innovin™ from Dade Behring. Clot formation is detected optically and time to clot is determined and compared against FVII-deficient plasma alone.

Potency can be determined in vivo, such as in vivo dog models. Coagulation to identify a modified FVIIa with sufficient potency can be assessed using the aPTT and/or TEG test (see, e.g., Example 1).

Clinical Assays

Many assays are available to assess activity of FVIIa prior to clinical use. Such assays can include assessment of coagulation, protein stability and half-life in vivo, and phenotypic assays. Phenotypic assays and assays to assess the therapeutic effect of FVIIa treatment include assessment of blood levels of FVII (e.g. measurement of serum FVII prior to administration and time-points following administrations including, after the first administration, immediately after last administration, and time-points in between, correcting for the body mass index (BMI)), assessment of blood coagulation in vitro using the methods described above following treatment with FVIIa (e.g. PT assay), and phenotypic response to FVII treatment including amelioration of symptoms over time compared to subjects treated with an unmodified and/or wild type FVIIa or placebo. Patients treated with FVIIa polypeptides can be monitored for blood loss, transfusion requirement, and hemoglobin. Patients can be monitored regularly over a period of time for routine or repeated administrations, or following administration in response to acute events, such as hemorrhage, trauma, or surgical procedures.

Formulations

Pharmaceutical compositions containing a modified FVIIa can be formulated in any conventional manner by mixing a selected amount of the polypeptide with one or more physiologically acceptable carriers or excipients, for use in on-demand treatments provided herein. Selection of the carrier or excipient is within the skill of the administering profession and can depend upon a number of parameters. These include, for example, the mode of administration and disorder treated. The pharmaceutical compositions provided herein can be formulated for single dosage (direct) administration or for dilution or other modification. The concentrations of the compounds in the formulations are effective for delivery of an amount, upon administration, that is effective for the intended treatment. Typically, the compositions are formulated for single dosage administration, but not necessarily. In some embodiments, to formulate a composition, the weight fraction of a compound or mixture thereof is dissolved, suspended, dispersed, or otherwise mixed in a selected vehicle at an effective concentration such that the treated condition is relieved or ameliorated.

In some embodiments, a pharmaceutical composition for single dosage on-demand subcutaneous administration is provided, comprising a single therapeutically effective dose of a modified FVIIa in a pharmaceutically acceptable carrier for subcutaneous administration for on-demand treatment of a bleed. In some embodiments, the modified FVIIa of the pharmaceutical composition comprises modifications at least at a position corresponding to position 286 and at a position corresponding to position 298, and optionally modifications at least at a position corresponding to position 128 and at a position corresponding to position 129 in a FVII polypeptide comprising the sequence of amino acids set forth in SEQ ID NO: 3 or in a corresponding residue in a FVII polypeptide, wherein the modification at position 286 is an amino acid replacement with Arg (R), the modification at position 298 is an amino acid replacement with Gln (Q), the modification at position 128 is an amino acid replacement with Asn (N), and the modification at position 129 is Ala (A), and wherein the modified FVIIa has an activity or potency greater than the FVIIa that is unmodified. In some embodiments, a method of treating a bleed in a subject is provided, comprising subcutaneous administration of the pharmaceutical composition provided herein. In some embodiments, the subcutaneous administration of a modified FVIIa polypeptide or a pharmaceutical composition comprising a modified FVIIa polypeptide is administered to a subject with the use of a device. In some embodiments, the device is an injector pen. In some embodiments, the subcutaneous administration is performed on-demand after detection of a bleeding event. In some embodiments, the subcutaneous administration is performed on-demand before the bleeding event. In some embodiments, the subcutaneous administration is performed on-demand prophylactically before the bleeding event. In some embodiments, the subcutaneous administration is performed on-demand after the bleeding event. In some embodiments, the subcutaneous administration is performed on-demand after the bleeding event, until the bleeding event has stopped or has been reduced or the bleed has been corrected.

The modified FVIIa polypeptides provided herein can be formulated for administration to a subject as a two-chain FVIIa protein. The modified FVII polypeptides can be activated (i.e., as FVIIa) by any method known in the art prior to formulation.

Dosages

As it will be appreciated, the precise amount or dose of the therapeutic agent administered depends on the particular FVIIa polypeptide, the route of administration, and other considerations, such as the severity of the disease and the weight and general state of the subject. If necessary, a particular dosage and duration and treatment protocol can be empirically determined or extrapolated. For example, exemplary doses of recombinant and native FVIIa polypeptides can be used as a starting point to determine appropriate dosages. For example, a wild type recombinant FVII (rFVII) polypeptide that has been activated to rFVIIa, NovoSeven®, has been administered intravenously to patients with hemophilia A or hemophilia B, who are experiencing a bleeding episode, at a dosage of 90 µg/kg by bolus infusion over 2 to 5 minutes, achieving an effective circulating level of at least 2 µg/ml. The dose is repeated every 2 hours until hemostasis is achieved. The modified FVIIa polypeptides provided herein can be effective at reduced dosage amounts and/or frequencies compared to such a recombinant FVIIa, or can be improved over a wild type recombinant FVIIa for treatment of hemophilia A or hemophilia B. For example, the modified FVIIa polypeptides provided herein can be administered at a dosage of 80 µg/kg, 70 µg/kg, 60 µg/kg, 50 µg/kg, 40 µg/kg, 30 µg/kg, 20 µg/kg, 15 µg/kg, 10 µg/kg, or less, and administered subcutatenously. In some embodiments, the subcutanteous dosages can be higher, such as 100 µg/kg, 110 µg/kg, 120 µg/kg, or higher. The duration of treatment and the interval between injections may vary with the severity of the bleed and the response of the patient to the treatment, and can be adjusted accordingly. Factors such as the level of activity and half-life of the modified FVIIa in comparison to the unmodified FVIIa can be taken into account when making dosage determinations.

In another example, a recombinant FVII (rFVII) polypeptide that has been activated to rFVIIa, NovoSeven®, has been intravenously administered to patients with congenital FVII deficiency who are experiencing a bleeding episode, at a dosage of 15-30 µg/kg by bolus infusion over 2 to 5 minutes. The dose is repeated every 4-6 hours until hemostasis is achieved. The modified FVIIa polypeptides provided herein can be effective at reduced dosage amounts and/or frequencies compared to such a recombinant FVIIa, when administered in an on-demand subcutaneous manner. For example, the modified FVIIa polypeptides provided herein can be administered at a dosage of 20 µg/kg, 15 µg/kg, 10 µg/kg, 5 µg/kg, 3 µg/kg or less for the treatment of FVII deficiency. In some examples, the dosages can be higher, such as 35 µg/kg, 40 µg/kg, 45 µg/kg, or higher. The duration of treatment and the interval between injections will vary with the severity of the bleed and the response of the patient to the treatment, and can be adjusted accordingly. Factors such as the level of activity and half-life of the modified FVIIa in comparison to the unmodified FVIIa can be used in making dosage determinations. For example, a modified FVIIa polypeptide that exhibits a longer half-life than an unmodified FVIIa polypeptide can be administered at lower doses and/or less frequently than the unmodified FVIIa polypeptide. Similarly, the dosages required for therapeutic effect using a modified FVIIa polypeptide that displays increased coagulant activity compared with an unmodified FVIIa polypeptide can be reduced in frequency and amount. Particular dosages and regimens can be empirically determined by one of skill in the art.

In some embodiments, a single subcutaneous dose of the modified FVIIa polypeptides provided herein for the treatment of a bleeding disorder, e.g. Hemophilia A or B, is from about 10 µg/kg to 30 µg/kg, 10 µg/kg to 60 µg/kg, 10 µg/kg to 90 µg/kg, 10 µg/kg to 120 µg/kg, 30 µg/kg to 60 µg/kg, 30 µg/kg to 90 µg/kg, 30 µg/kg to 120 µg/kg, 10 µg/kg to 500 µg/kg, or 15 µg/kg to 400 µg/kg, or 15 µg/kg to 350 µg/kg, or 20 µg/kg to 400 µg/kg, or 20 µg/kg to 350 µg/kg, or 30 µg/kg to 350 µg/kg, or 25 µg/kg to 350 µg/kg, based on the weight of a treated subject. In some embodiments, a single subcutaneous dose is about 30 µg/kg, 60 µg/kg, 90 µg/kg, or 120 µg/kg based on the weight of the treated subject. In exemplary embodiments, a single subcutatenous dose is about 60 µg/kg based on the weight of the treated subject. In exemplary embodiments, a single subcutaneous dose is about 20 µg/kg, based on the weight of the treated subject. In exemplary embodiments, a single subcutaneous dose is about 30 µg/kg, based on the weight of the treated subject. In exemplary embodiments, a single subcutaneous dose is about 40 µg/kg, based on the weight of the treated subject. In exemplary embodiments, a single subcutaneous dose is about 50 µg/kg, based on the weight of the treated subject. In exemplary embodiments, a single subcutaneous dose is about 90 µg/kg, based on the weight of the treated subject. In exemplary embodiments, a single subcutaneous dose is about 100 µg/kg, based on the weight of the treated subject. In exemplary embodiments, a single subcutaneous dose is about 120 µg/kg, based on the weight of the treated subject. In some embodiments, a single subcutaneous dose of the modified FVIIa polypeptides provided herein for the treatment of a disease or disorder, e.g. Factor VII Deficiency, is from about 10 µg/kg to about 20 µg/kg, based on body weight of a treated subject.

Dosage Forms

Pharmaceutical therapeutically active compounds and derivatives thereof are can be formulated and administered in unit dosage forms or multiple dosage forms. Formulations can be provided for administration to humans and animals in dosage forms that include, but are not limited to, tablets, capsules, pills, powders, granules, sterile parenteral solutions or suspensions, oral solutions or suspensions, and oil water emulsions containing suitable quantities of the compounds or pharmaceutically acceptable derivatives thereof. Each unit dose contains a predetermined quantity of therapeutically active compound sufficient to produce the desired therapeutic effect, in association with the required pharmaceutical carrier, vehicle or diluent. Examples of unit dose forms include ampoules and syringes and individually packaged tablets or capsules. In some examples, the unit dose is provided as a lyophilized powder that is reconstituted prior to administration. For example, the modified FVIIa polypeptides of the disclosure can be provided as lyophilized powder that is reconstituted with a suitable solution to generate a single dose solution for injection. For example, the modified FVIIa polypeptides of the disclosure provided as a lyophilized powder can be provided in a container or a device. In some embodiments, the container comprises two chambers, wherein one chamber contains the lyophilized composition; and another chamber comprises vehicle for dissolving the lyophilized composition. In such exemplary embodiments, the vehicle can be pushed from one chamber into the other chamber containing the lyophilized composition, thus reconstituting the FVIIa polypeptide that was provided in lyophilized form, and providing the FVIIa polypeptide in a composition suitable for administration to a subject in need thereof.

In some embodiments, the lyophilized powder can contain the FVIIa polypeptide and additional components, such as salts, such that reconstitution with sterile distilled water results in a FVIIa polypeptide in a buffered or saline solution. Unit dose forms can be administered in fractions or multiples thereof. A multiple dose form is a plurality of unit dosage forms packaged in a single container to be administered in segregated unit dose form. The dosages may be identical but need not be. Examples of multiple dose forms include vials, bottles of tablets or capsules or bottles of pints or gallons. Hence, multiple dose form can be provided as a multiple of unit doses that are not segregated in packaging.

Any of the modified FVIIa polypeptides of the disclosure provided herein may be provided as a single dose in a volume formulated to not exceed a predetermined maximum volume for a subject. For example, a volume may be formulated for administration to an infant, a child, and adolescent, or to an adult subject. A dosage formulated for a subject may be by weight, such as, for example, about 10 µg/kg to 120 µg/kg (e.g. 30 µg/kg 60 µg/kg, 1200 µg/kg), and provided in a volume of approximately 2-4 mL. In some embodiments, the volume does not exceed 3 mL. In some embodiments, the volume of a single provided dose does not exceed 1, or 2, or 3, or 4, or 5 mL. In some embodiments, the volume of a single provided dose does not exceed 1.5, or 2 mL. In some embodiments, the amount of a single provided dose is about 1 to about 6 mg in amount. In some embodiments, the volume of any single dose of any of the modified FVIIa polypeptides provided herein is about 1, about 1.5, about 2, about 2.5, about 3, about 3.5, about 4, about 4.5, about 5, about 5.5, about 6, or about 6.5 mL in volume. In some embodiments, the volume of any single dose of the modified FVIIa is about 4.5 mL in volume.

Administration of Modified FVIIa Polypeptides

The modified FVIIa polypeptides provided herein can be administered by contacting a mixture, such as a body fluid or other tissue sample, with a modified FVIIa polypeptide. For example, when administering a compound ex vivo, a body fluid or tissue sample from a subject can be contacted with the modified FVIIa polypeptides that are coated on a tube or filter, such as for example, a tube or filter in a bypass machine.

The modified FVIIa polypeptides can be administered once or more than once, such as twice, three times, four times, or any number of times that are required to achieve a therapeutic effect to a subject. Exemplary multiple dosing regimens are depicted in, for example, FIGS. 17A-17B. Multiple administrations can be effected via any route or combination of routes, and can be administered hourly, every 2 hours, every three hours, every four hours or more. A subject can be an adult, an adolescent, a child, or an infant.

In some embodiments, the modified FVIIa polypeptides provided herein can be administered in a method of treating a bleeding event in a subject, wherein the modified FVIIa polypeptides are administered subcutaneously within about 5 or 4 or 3 or 2 or 1 or fewer hours or minutes before and/or after the bleeding event, whereby the amount of bleeding is reduced or stopped or the cause of the bleed is corrected or is healed. In some embodiments, the modified FVIIa polypeptides provided herein are subcutaneously administered to a subject in need thereof, wherein the administration is a dose of a modified FVIIa comprising modifications at least at a position corresponding to position 286 and at a position corresponding to position 298 in a FVII polypeptide comprising the sequence of amino acids set forth in SEQ ID NO: 3 or in a corresponding residue in a FVII polypeptide, wherein:

the modification at position 286 is an amino acid replacement with Arg (R);

the modification at position 298 is an amino acid replacement with Gln (Q);

the subcutaneous administration of the modified FVIIa has increased activity or potency; and a dose of the modified FVIIa is administered subcutaneously within about 5 or 4 or 3 or 2 or 1 or fewer hours or minutes before and/or after the bleeding event, whereby the amount of bleeding is reduced or stopped or the cause of the bleed is corrected or is healed.

In some embodiments, the modified FVIIa polypeptides further comprise a modification at a position corresponding to position 128 in the FVII polypeptide having the sequence of amino acids set forth in SEQ ID NO: 3, wherein the modification at position 128 is an amino acid replacement with Asn (N). In some embodiments, the modified FVIIa polypeptides further comprise a modification at a position corresponding to position 129 and in the FVII polypeptide having the sequence of amino acids set forth in SEQ ID NO: 3, wherein the modification at position 129 is Ala (A).

In some embodiments, the subcutaneous administration of the modified FVIIa has an activity or potency greater than an intravenous administration of the modified FVIIa polypeptide. In some embodiments, the subcutaneous administration of the modified FVIIa has an activity or potency greater than an intravenous administration of an FVIIa polypeptide that is unmodified (or differently modified). In some embodiments, the subcutaneous administration of the modified FVIIa has an activity or potency greater than a subcutaneous administration of an FVIIa polypeptide that is unmodified (or differently modified).

In some embodiments, the modified FVIIa polypeptides provided herein are administered subcutaneously to a subject to treat a bleeding event in an on-demand treatment, such that the modified FVIIa polypeptides are administered after detection of the bleeding event. In some embodiments, the modified FVIIa is administered subcutaneously within about 5 or 4 or 3 or 2 or 1 or fewer hours or minutes after the bleeding event, whereby the amount of bleeding is reduced or stopped or the cause of the bleed is corrected or is healed.

In some embodiments, the dose of the modified FVIIa is administered subcutaneously within about 5 hours before the bleeding event. In some embodiments, the dose of the modified FVIIa is administered subcutaneously within about 4 hours before the bleeding event. In some embodiments, the dose of the modified FVIIa is administered subcutaneously within about 3 hours before the bleeding event. In some embodiments, the dose of the modified FVIIa is administered subcutaneously within about 2 hours before the bleeding event. In some embodiments, the dose of the modified FVIIa is administered subcutaneously within about 1 hour before the bleeding event. In some embodiments, the dose of the modified FVIIa is administered subcutaneously within about 5 hours after the bleeding event. In some embodiments, the dose of the modified FVIIa is administered subcutaneously within about 4 hours after the bleeding event. In some embodiments, the dose of the modified FVIIa is administered subcutaneously within about 3 hours after the bleeding event. In some embodiments, the dose of the modified FVIIa is administered subcutaneously within about 2 hours after the bleeding event. In some embodiments, the dose of the modified FVIIa is administered subcutaneously within about 1 hour after the bleeding event. In some embodiments, the dose of the modified FVIIa is administered subcutaneously within about 5 minutes before the bleeding event. In some embodiments, the dose of the modified FVIIa is administered subcutaneously within about 4 minutes before the bleeding event. In some embodiments, the dose of the modified FVIIa is administered subcutaneously within about 3 minutes before the bleeding event. In some embodiments, the dose of the modified FVIIa is administered subcutaneously within about 2 minutes before the bleeding event. In some embodiments, the dose of the modified FVIIa is administered subcutaneously within about 1 minute before the bleeding event. In some embodiments, the dose of the modified FVIIa is administered subcutaneously within about 5 minutes after the bleeding event. In some embodiments, the dose of the modified FVIIa is administered subcutaneously within about 4 minutes after the bleeding event. In some embodiments, the dose of the modified FVIIa is administered subcutaneously within about 3 minutes after the bleeding event. In some embodiments, the dose of the modified FVIIa is administered subcutaneously within about 2 minutes after the bleeding event. In some embodiments, the dose of the modified FVIIa is administered subcutaneously within about 1 minute after the bleeding event.

In some embodiments, the modified FVIIa polypeptides provided herein are administered subcutaneously a plurality of times until a bleeding event to be treated stops, or a wound to be treated heals, or the bleeding is reduced, stopped, or otherwise corrected.

In some embodiments, the modified FVIIa polypeptides provided herein are administered subcutaneously in a method of providing an on-demand treatment to a subject experiencing a bleed or to a subject likely to experience a bleed, comprising administering to the subject a subcutaneous dose of a modified FVII, wherein the modified FVII is an activated FVII (modified FVIIa) and the modified FVIIa comprises modifications at least at a position corresponding to position 286 and at a position corresponding to position 298 in a FVII polypeptide comprising the sequence of amino acids set forth in SEQ ID NO: 3 or in a corresponding residue in a FVII polypeptide, wherein: the modification at position 286 is an amino acid replacement with Arg (R); the modification at position 298 is an amino acid replacement with Gln (Q); and the dose is about 10 to about 100 µg/kg of body weight of the subject. In some embodiments, the modified FVIIa further comprises a modification at a position corresponding to position 128 in the FVII polypeptide having the sequence of amino acids set forth in SEQ ID NO: 3, wherein: the modification at position 128 is an amino acid replacement with Asn (N). In some embodiments, the modified FVIIa further comprises a modification at a position corresponding to position 129 and in the FVII polypeptide having the sequence of amino acids set forth in SEQ ID NO: 3, wherein: the modification at position 129 is Ala (A).

In some exemplary embodiments, a subject to be treated with any of the modified FVIIa polypeptides provided herein weighs about 75 kg, and a dose of the modified FVIIa polypeptides is provided to the subject at a dosage of about 60 µg/kg. In such exemplary embodiments, the provided dose of the modified FVIIa polypeptide is provided in an amount of about 4.5 mg. In some embodiments, a single dose of the 4.5 mg amount is administered to the subject. In some embodiments, multiple doses of the modified FVIIa polypeptide are administered to the subject. In some exemplary embodiments, a subject to be treated with any of the modified FVIIa polypeptides provided herein is about 30 kg, or about 60 kg, or about 75 kg, or about 100 kg. In such exemplary embodiments, the provided volumes of the modified FVIIa polypeptides can be determined empirically based on body weight of subject. For example, in some embodiments, a dose of the modified FVIIa polypeptide can be provided at a dose of 60 µg/kg, and can be provided in an amount of about 1.5 mg for a subject of about 25 kg, or about 1.8 mg for a subject of about 30 kg, or about 3 mg for a subject of about 50 kg, or about 3.6 mg for a subject of about 60 kg, or about 4.5 for a subject of about 75 kg, or about 6 mg for a subject of about 100 kg.

In some embodiments, a dose of the modified FVIIa polypeptide can be provided at a dose of 20 µg/kg, and can be provided in an amount of about 1.5 mg for a subject of about 75 kg, or about 2 mg for a subject of about 100 kg, or about 1 mg for a subject of about 50 kg, or about 0.5 mg for a subject of about 25 kg.

In some embodiments, a dose of the modified FVIIa polypeptide can be provided at a dose of 120 µg/kg, and can be provided in an amount of about 95 mg for a subject of about 75 kg, or about 12 mg for a subject of about 100 kg, or about 6 mg for a subject of about 50 kg, or about 3 mg for a subject of about 25 kg.

In some embodiments, the dose is about 20 µg/kg to about 60 µg/kg of body weight of the subject. In some embodiments, the dose is about 60 µg/kg of body weight of the subject. In some embodiments, the subject has hemophilia. In some embodiments, the subject has hemophilia with inhibitors. In some embodiments, the subject has hemophilia, with or without inhibitors, and the dose is about 60 µg/kg. In some embodiments, the subject has hemophilia, with or without inhibitors, and the dose is about 120 µg/kg.

In some embodiments, the subject has Factor VII deficiency, and the dose is about 10 µg/kg, based on body weight of the subject. In some embodiments, the subject has Factor VII deficiency, and the dose is about 20 µg/kg, based on body weight of the subject.

In some embodiments, the modified FVIIa polypeptides provided herein are administered subcutaneously in a multiple dosing regimen. In some embodiments, the multiple dosing regimen comprises at least two, three, four five, or six doses within about 24 hours. In some embodiments, the multiple dosing regimen comprises no more than two, three, four five, or six doses within about 24 hours. In some embodiments, at least one dose of the multiple dosing regimen comprises about 30, about 45, about 60, about 90, or about 120 µg/kg of body weight of the subject. In some embodiments, each dose of the multiple dosing regimen is identical. In some embodiments, each dose of the multiple dosing regimen is not identical. In some embodiments, each dose of the multiple dosing regimen occurs about 2 to about 6 hours apart for a predetermined time period. In some embodiments, the predetermined time period is about 24 hours. In some embodiments, the multiple dosing regimen comprises a maximum of three doses within the 24 hour period. In some embodiments, the multiple dosing regimen comprises a maximum of two, or three, or four, or five, or six doses within the 24 hour period. In some embodiments, each dose of the multiple dosing regimen is 30 µg/kg, 45 µg/kg, 60 µg/kg, 90 µg/kg, or 120 µg/kg, based on the weight of the treated subject, e.g. an adult, an adolescent, a child, or an infant.

In some embodiments, a bleeding event in a subject is treated with a multiple dosing regimen of any of the modified FVIIa polypeptides provided herein, wherein the multiple dosing regimen is administered as an ascending dosing regimen, wherein each dose of the multiple dosing regimen is a higher dose than the previous dose.

In some embodiments, any of the modified FVIIa polypeptides provided herein are administered to a subject in a multiple dosing regimen using subcutaneous administration. In some embodiments, a multiple dosing regimen of any of the modified FVIIa polypeptides provided herein is administered in anticipation of a bleed, or once a bleed has begun. In some embodiments, the multiple dosing regimen is administered as an ascending dosing regimen.

In some embodiments, a bleeding event in a subject is treated with a multiple dosing regimen of any of the modified FVIIa polypeptides provided herein, wherein at least one dose of the modified FVIIa polypeptides is administered intravenously prior to subcutaneous administration of the modified FVIIa polypeptides.

In some embodiments, any single dose of the multiple dosing regimen administering any of the modified FVIIa polypeptides provided herein is administered as a split dose, wherein a single dose is provided with more than injection. In some embodiments, the split dose is administered at two different anatomical sites of the subject. In some embodiments, the split dose is administered at the same anatomical site of the subject.

The most suitable route for administration will vary depending upon the disease state to be treated, for example the location of the bleeding disorder. In some embodiments, treatment of a bleed or in anticipation of a bleed is administered by a subcutaneous administration of a multiple dosing regimen of the FVIIa polypeptides provided herein. In some embodiments, the multiple doses are administered to different anatomical sites. Exemplary administration to different anatomical sites is discussed further in Example 9 and depicted in FIGS. 17A-17B. Exemplary anatomical sites at which any dose of any of the modified FVIIa polypeptides provided herein can be administered include, but are not limited to, the thigh, the abdomen, the arm. Multiple doses can be administered in alternating sites, for example the first dose may be administered in the thigh, and the second dose may be administered in the abdomen. Likewise, a first dose may be administered on one side of the body at one anatomical site, and the next dose may be administered on the other side of the body, at the same, or different anatomical site.

The instances where the modified FVIIa polypeptides are be formulated as a depot preparation, the long-acting formulations can be administered by implantation (for example, subcutaneously or intramuscularly) or by intramuscular injection. Thus, for example, the therapeutic compounds can be formulated with suitable polymeric or hydrophobic materials (for example as an emulsion in an acceptable oil) or ion exchange resins, or as sparingly soluble derivatives, for example, as a sparingly soluble salt.

The compositions, if desired, can be presented in a package, in a kit or dispenser device, that can contain one or more unit dosage forms containing the active ingredient. In some embodiments, the device is provided as an injector pen. The package, for example, contains metal or plastic foil, such as a blister pack. The pack or dispenser device can be accompanied by instructions for administration. The compositions containing the active agents can be packaged as articles of manufacture containing packaging material, an agent provided herein, and a label that indicates the disorder for which the agent is provided.

Administration of Nucleic Acids Encoding Modified FVII Polypeptides (Gene Therapy)

Also provided are compositions of nucleic acid molecules encoding the modified FVII polypeptides and expression vectors encoding them that are suitable for gene therapy. Rather than deliver the protein, nucleic acid can be administered in vivo, such as systemically or by other route, or ex vivo, such as by removal of cells, including lymphocytes, introduction of the nucleic therein, and reintroduction into the host or a compatible recipient.

Modified FVII polypeptides can be delivered to cells and tissues by expression of nucleic acid molecules. Modified FVII polypeptides can be administered as nucleic acid molecules encoding modified FVII polypeptides, including ex vivo techniques and direct in vivo expression. Nucleic acids can be delivered to cells and tissues by any method known to those of skill in the art. The isolated nucleic acid sequences can be incorporated into vectors for further manipulation. As used herein, vector (or plasmid) refers to discrete elements that are used to introduce heterologous DNA into cells for either expression or replication thereof. Selection and use of such vehicles are well within the skill of the artisan.

Methods for administering modified FVII polypeptides by expression of encoding nucleic acid molecules include administration of recombinant vectors. The vector can be designed to remain episomal, such as by inclusion of an origin of replication or can be designed to integrate into a chromosome in the cell. Modified FVII polypeptides also can be used in ex vivo gene expression therapy using non-viral vectors. For example, cells can be engineered to express a modified FVII polypeptide, such as by integrating a modified FVII polypeptide encoding-nucleic acid into a genomic location, either operatively linked to regulatory sequences or such that it is placed operatively linked to regulatory sequences in a genomic location. Such cells then can be administered locally or systemically to a subject, such as a patient in need of treatment.

Therapeutic Uses

The modified FVIIa polypeptides provided herein can be used for treatment of any condition for which recombinant FVII-based therapies are employed. Typically, such treatments include those where increased coagulation, such as increased hemostatic responses, are desired. Modified FVIIa polypeptides have therapeutic activity alone or in combination with other agents. The modified polypeptides provided herein are designed to retain therapeutic activity but exhibit modified properties, particularly increased resistance to AT-III and increased catalytic activity. The modified polypeptides provided herein also can exhibit increased resistance to TFPI, increased resistance to the inhibitory effects of $Zn^{2+}$, improved pharmacokinetic properties, such as serum half-life, increased binding and/or affinity for activated platelets, increased binding and/or affinity for serum albumin, and/or increased binding and/or affinity for platelet integrin $\alpha_{IIb}\beta_3$. Such modified properties, for example, can improve the therapeutic effectiveness of the polypeptides due to increased coagulant activity of the modified FVIIa polypeptides. This section provides exemplary uses of and administration methods. These described therapies are exemplary and do not limit the applications of modified FVIIa polypeptides.

The modified FVIIa polypeptides provided herein can be used in various therapeutic as well as diagnostic methods in which FVII is employed. Such methods include, but are not limited to, methods of treatment of physiological and medical conditions described and listed below. Modified FVIIa polypeptides provided herein can exhibit improvement of in vivo activities and therapeutic effects compared to wild-type FVII, including lower dosage to achieve the same effect, and other improvements in administration and treatment such as fewer and/or less frequent administrations, decreased side effects and increased therapeutic effects. Although it is understood that the modified FVIIa polypeptides can be administered as a FVII zymogen (i.e. single chain form), typically the modified FVIIa polypeptides provided herein are administered in activated two-chain form following, for example, autoactivation or activation by other coagulation factors, such as during purification.

In particular, modified FVIIa polypeptides are intended for use in therapeutic methods in which FVII has been used for treatment. Such methods include, but are not limited to, methods of treatment of diseases and disorders, such as, but not limited to, blood coagulation disorders, hematologic disorders, hemorrhagic disorders, hemophilias, such as hemophilia A, hemophilia B and factor VII deficiency, and acquired blood disorders, such as acquired factor VII deficiency caused by liver disease. Modified FVIIa polypeptides also can be used in the treatment of additional bleeding diseases and disorders, such as, but not limited to, thrombocytopenia (e.g., such as due to chemotherapeutic regimes), Von Willebrand's disease, hereditary platelet disorders (e.g., storage pool disease such as Chediak-Higashi and Hermansky-Pudlak syndromes, thromboxane A2 dysfunction, Glanzmann's thrombasthenia, and Bernard-Soulier syndrome), hemolytic-uremic syndrome, Hereditary Hemorrhagic Telangiectsasia, also known as Rendu-Osler-Weber syndrome, allergic purpura (Henoch Schonlein purpura) and disseminated intravascular coagulation.

In some embodiments, the bleedings to be treated by FVIIa polypeptides occur in organs such as the brain, inner ear region, eyes, liver, lung, tumor tissue, gastrointestinal tract. In other embodiments, the bleeding is diffuse, such as in hemorrhagic gastritis and profuse uterine bleeding. Patients with bleeding disorders, such as for example, hemophilia A and B, often are at risk of bleeding complications during surgery or trauma. Such bleeding can be manifested as acute hemarthroses (bleedings in joints), chronic hemophilic arthropathy, hematomas, (e.g., muscular, retroperitoneal, sublingual and retropharyngeal), hematuria (bleeding from the renal tract), central nervous system bleedings, gastrointestinal bleedings (e.g., UGI bleeds) and cerebral hemorrhage, which also can be treated with modified FVIIa polypeptides. Additionally, any bleeding associated with surgery (e.g., hepatectomy), or dental extraction can be treated with modified FVIIa polypeptides. In one embodiment, the modified FVIIa polypeptides can be used to treat bleeding episodes due to trauma, or surgery, or lowered count or activity of platelets, in a subject. Exemplary methods for patients undergoing surgery include treatments to prevent hemorrhage and treatments before, during, or after surgeries such as, but not limited to, heart surgery, angioplasty, lung surgery, abdominal surgery, spinal surgery, brain surgery, vascular surgery, dental surgery, or organ transplant surgery, including transplantation of bone marrow, heart, lung, pancreas, or liver. In some embodiments, a subject to be treated for a bleeding event and having a bleeding event is undergoing surgery, and a dose of a modified FVIIa polypeptide provided herein is subcutaneously administered before surgery, for example, 4, 3, 2, 1 hours or less before surgery.

Treatment of diseases and conditions with modified FVIIa polypeptides can be effected by any suitable route of administration using suitable formulations as described herein including, but not limited to, injection, pulmonary, oral and transdermal administration. In some embodiments, treatment of diseases and conditions with modified FVIIa polypeptides can be effected by subcutaneous administration of the FVIIa polypeptides.

If necessary, a particular dosage and duration and treatment protocol can be empirically determined or extrapolated. For example, exemplary doses of recombinant and native FVIIa polypeptides can be used as a starting point to determine appropriate dosages. For example, a recombinant FVII (rFVIIa) polypeptide that has been activated to rFVIIa, NovoSeven®, has been intravenously administered to patients with hemophilia A or hemophilia B, who are experiencing a bleeding episode, at a dosage of 90 µg/kg by bolus infusion over 2 to 5 minutes, achieving an effective circulating level of at least 2 µg/ml, with a mean half-life of 2.7 hours. The dose is repeated every 2 hours until hemostasis is achieved. Modified FVIIa polypeptides that are have an increased coagulant activity, due to, for example, increased resistance to AT-III, increased catalytic activity, increased resistance to the inhibitory effects of $Zn^{2+}$, increased resistance to TFPI, improved pharmacokinetic properties, such as increased serum half-life, increased binding and/or affinity for activated platelets, increased binding and/or affinity for serum albumin, and/or increased binding and/or affinity for platelet integrin $\alpha_{IIb}\beta_3$, can be effective at reduced dosage amounts and/or frequencies compared to such a recombinant FVIIa. For example, a dosage of about 60 µg/kg based on body weight of a subject can be provided for a subcutaneous dose of a modified FVIIa polypeptide, in comparison to a dosage of about 120 µg/kg needed for a subcutaneous dose of an FVIIa polypeptide that is unmodified. The unmodified FVIIa polypeptide may be difficult to administer subcutaneously to a subject due to the larger volume needed for administration of such higher dosages. Dosages for wild-type or unmodified FVIIa polypeptides can be used as guidance for determining dosages for modified FVIIa polypeptides. Factors such as the level of activity and half-life of the modified FVIIa in comparison to the unmodified FVII can be used in making such determinations. Particular dosages and regimens can be empirically determined.

In some embodiments, some exemplary modified FVIIa polypeptides provided herein may exhibit improved pharmacokinetic properties over other modified FVIIa polypeptides when administered subcutaneously. Of particular note, it is surprising and unexpected that subcutaneous administration of the modified FVIIa polypeptides exhibit increased potency, coagulation activity, and extended duration and prolonged exposure, as compared to an unmodified FVII, at doses lower than would have been expected. An exemplary modified FVIIa polypeptide that exhibits improved pharmacokinetic properties comprises the mutations T128N/P129A/Q286R/M298Q, which results in an activated FVIIa polypeptide comprising modifications at least at a position corresponding to position 128, at a position corresponding to position 129, at a position corresponding to position 286, and at a position corresponding to position 298 in the FVII polypeptide having the sequence of amino acids set forth in SEQ ID NO: 3, wherein the modification at position 128 is an amino acid replacement with Asn (N), the modification at position 129 is Ala (A), the modification at position 286 is an amino acid replacement with Arg (R), and the modification at position 298 is an amino acid replacement with Gln (Q). This exemplary modified FVIIa polypeptide may exhibit improved pharmacokinetic properties when compared to another exemplary modified FVII, T128N/P129A, which is an FVIIa polypeptide comprising modifications at least at a position corresponding to position 128 and at a position corresponding to position 129 in the FVII polypeptide having the sequence of amino acids set forth in SEQ ID NO: 3, wherein the modification at position 128 is an amino acid replacement with Asn (N), and the modification at position 129 is Ala (A). In exemplary embodiments, the exemplary FVIIa polypeptide comprises the sequence of SEQ ID NO: 280.

Dosage levels and regimens can be determined based upon known dosages and regimens, and, if necessary can be extrapolated based upon the changes in properties of the modified polypeptides and/or can be determined empirically based on a variety of factors. Such factors include body weight of the individual, general health, age, the activity of the specific compound employed, sex, diet, time of administration, rate of excretion, drug combination, the severity and course of the disease, and the patient's disposition to the disease and the judgment of the treating physician. The active ingredient, the polypeptide, typically is combined with a pharmaceutically effective carrier. The amount of active ingredient that can be combined with the carrier materials to produce a single dosage form or multi-dosage form can vary depending upon the host treated and the particular mode of administration.

The effect of the FVIIa polypeptides on the clotting time of blood can be monitored using any of the clotting tests known in the art including, but not limited to, whole blood prothrombin time (PT), the activated partial thromboplastin time (aPTT), the activated clotting time (ACT), the recalcified activated clotting time, or the Lee-White Clotting time.

Upon improvement of a patient's condition, a maintenance dose of a compound or compositions can be administered, if necessary; and the dosage, the dosage form, or frequency of administration, or a combination thereof can be modified. In some cases, a subject can require intermittent treatment on a long-term basis upon any recurrence of disease symptoms or based upon scheduled dosages. In other cases, additional administrations can be required in response to acute events such as hemorrhage, trauma, or surgical procedures. In some embodiments, the bleeding event in a subject to be treated results from trauma or injury, and the subject is treated with a subcutaneous dose of a modified FVIIa provided herein within 15 minutes, 1, 2, 3, or 4 hours before and/or after the bleeding.

Exemplary conditions for which FVII (administered as FVIIa) can be used as a treatment agent alone or in combination with other agents are described in PCT Publication No. WO2009126307A2, which is incorporated by reference in its entirety. These include, but are not limited to, congenital or acquired bleeding disorders, transplant-acquired bleeding, anticoagulant therapy-induced bleeding, acquired hemophilia, and trauma and surgical bleeding. Congenital bleeding disorders include, but are not limited to, hemophilia (such as Hemophilia A and Hemophilia B), FVII deficiency, FV deficiency, FX deficiency, von Willebrand Factor (vWD), and platelet-related bleeding disorders (such as for example, Glanzmann's thrombasthenia and Hermansky-Pudlak syndrome). Acquired bleeding disorders include, but are not limited to, chemotherapy-acquired thrombocytopenia, acquired coagulopathies resulting from conditions such as fulminant hepatic failure (FHF), liver disease, vitamin K deficiency, hemolytic uremic syndrome, thrombotic thrombocytopenia (TTC) and disseminated intravascular coagulopathy (DIC). The bleeding event to be treated in a subject can also include bleeding events that are episodic or predictable by the subject. In some embodiments, the subject is treated with a subcutaneous dose of a modified FVIIa polypeptide provided herein before the bleeding starts. In some embodiments, the subject is treated with a subcutaneous dose of a modified FVIIa polypeptide provided herein after the bleeding starts.

In some embodiments, the modified FVIIa polypeptides provided herein are useful for on-demand treatment of a bleeding event. Any of the modified FVIIa polypeptides provided herein may be administered to a subject that has detected a bleeding event. These modified FVIIa polypeptides may be administered subcutaneously. In some embodiments, the bleeding event in a subject is treated with on-demand, subcutaneous administration of at least a single dose of any of the FVIIa polypeptides provided herein.

Modified FVIIa Polypeptides as a Monotherapy

Any of the modified FVIIa polypeptides described herein can be administered as a monotherapy. As used herein, "monotherapy" can refer to administration any one of the modified FVIIa polypeptides described herein without the additional administration of other therapeutic agents, such as, for example, but not limited, other biologics, and small molecule compounds. The monotherapy may be administered to a subject in need thereof according to any of the administration methods described herein. In some embodiments, the FVIIa polypeptides provided herein are administered subcutaneously and administered as a monotherapy.

Combination Therapies

Any of the modified FVIIa polypeptides described herein can be administered in combination with, prior to, intermittently with, or subsequent to, other therapeutic agents or procedures including, but not limited to, other biologics, small molecule compounds and surgery. For any disease or condition, including all those exemplified above, for which FVII (including FVIIa and rFVIIa) is indicated or has been used and for which other agents and treatments are available, FVII can be used in combination therewith. Hence, the modified FVIIa polypeptides provided herein similarly can be used. Depending on the disease or condition to be treated, exemplary combinations include, but are not limited to, combination with other plasma purified or recombinant coagulation factors, procoagulants, such as vitamin K, vitamin K derivative and protein C inhibitors, plasma, platelets, red blood cells and corticosteroids.

In some embodiments, the modified FVIIa polypeptides provided herein are administered to a subject with an additional coagulant treatment or factor, or other agent. In some embodiments, the treatment comprises administration of antibody emicizumab-kxwh and/or a factor eight (FVIII) inhibitor bypass activity product.

In some embodiments, the modified FVIIa polypeptides provided herein are administered to a subject with an anti-tissue factor pathway inhibitor (TFPI) antibody. In some embodiments, the anti-TFPI antibody is concizumab.

In some embodiments, the modified FVIIa polypeptides provided herein are administered to a subject in combination with an RNA interference (RNAi) therapeutic targeting antithrombin (AT). In some embodiments, the RNAi therapeutic targeting AT is fitusiran.

Articles of Manufacture and Kits

Pharmaceutical compounds of modified FVIIa polypeptides or nucleic acids encoding modified FVII polypeptides, or a derivative or a biologically active portion thereof can be packaged as articles of manufacture containing packaging material, a pharmaceutical composition which is effective for treating a hemostatic disease or disorder, and a label that indicates that modified FVIIa polypeptide or nucleic acid molecule is to be used for treating hemostatic disease or disorder.

Modified FVIIa polypeptides and nucleic acid molecules also can be provided as kits. Kits can include a pharmaceutical composition described herein and an item for administration. For example a modified FVIIa can be supplied with a device for administration, such as a syringe, an inhaler, a dosage cup, a dropper, or an applicator. The kit can, optionally, include instructions for application including dosages, dosing regimens and instructions for modes of administration. Kits also can include a pharmaceutical composition described herein and an item for diagnosis. For example, such kits can include an item for measuring the concentration, amount or activity of FVIIa or a FVIIa regulated system of a subject.

In some exemplary embodiments, provided herein is a kit comprising at least three vials, each vial comprising a single dose of a modified FVIIa polypeptide for subcutaneous administration, or a pharmaceutical composition thereof. In some embodiments, the modified FVIIa polypeptide comprises the amino acid sequence of SEQ ID NO: 280. In some embodiments, each vial comprises the modified FVIIa polypeptide comprising the amino acid sequence of SEQ ID NO: 280, and each vial comprises an identical dose, for example, a dose sufficient to subcutaneously administer a dose of 60 µg/kg of body weight of a subject in need thereof. In other embodiments, each vial comprises an FVIIa polypeptide comprising the amino acid sequence of SEQ ID NO: 280, and the doses in the vials are not identical. In some embodiments, all of the vials in the kit are administered during a 24-hour period. In some embodiments, all of the vials in the kit are administered during a 24-hour period, wherein the FVIIa polypeptide is administered in a multiple dosing regimen, wherein each dose of the multiple dosing regimen is identical, and wherein each dose of the multiple dosing regimen is about three hours apart. In some embodiments, each dose of the multiple dosing regimen is about 30 µg/kg, 45 µg/kg, 60 µg/kg, 90 µg/kg, or 120 µg/kg of body weight of a subject in need thereof. In some embodiments, the FVIIa polypeptide is administered once to the subject, and one or more repeated doses of the FVIIa polypeptide are administered as needed until a bleed is stopped. In some embodiments, the one or more repeated doses is one dose, or two doses, or three doses.

Exemplary Enumerated Embodiments

Exemplary enumerated embodiments of the disclosure are as follows:

Embodiment I-1. A method of treating a bleeding event in a subject, comprising subcutaneously administering a dose of modified Factor VIIa (FVIIa), wherein:

the modified FVIIa has an activity or potency greater than the FVIIa, which is unmodified and the amino acid sequence is set forth in SEQ ID NO: 3; and a dose of the modified FVIIa is administered subcutaneously within about 5 or 4 or 3 or 2 or 1 or fewer hours or minutes before and/or after the bleeding event, whereby the amount of bleeding is reduced or stopped or the cause of the bleed is corrected or is healed.

Embodiment I-2. The method of embodiment I-1, wherein the subcutaneous dose of the modified FVIIa is administered subcutaneously every 3-7, 2-5, 4-6, or 4-12 hours until the bleeding stops, or the cause is corrected, or any wound is healed or for 1 to 2, 3, 4, or 5 days.

Embodiment I-3. The method of embodiment I-1 or I-2, wherein the dose of modified FVIIa is administered every 1, 2, 3, 4, 5, 6, 7, 8, 9, 10, 11, or 12 hours.

Embodiment I-4. The method of any of embodiments I-1 to I-3, wherein:

the bleeding is episodic or predictable by the subject; and the subject is treated with a subcutaneous dose of the modified FVIIa before the bleeding starts.

Embodiment I-5. The method of any of embodiments I-1 to I-3, wherein: the bleeding results from trauma or injury; and the subject is treated with a subcutaneous dose of the modified FVIIa within 15 minutes, 1, 2, 3, or 4 hours of the bleeding.

Embodiment I-6. The method of any of embodiments I-1 to I-5, wherein:

the subject has a hemophilia or other bleeding disorder or condition, and is undergoing surgery;

a dose of the modified FVIIa is subcutaneously administered 4, 3, 2, 1 hours or less before surgery;

the subject is treated with a FVIIa intravenously during surgery; and a dose of the modified FVIIa is subcutaneously administered at least one-time before or following surgery until there is no bleeding and/or risk of bleeding or until the subject is healed or the cause is corrected.

Embodiment I-7. The method of any of embodiments I-1 to I-5, wherein:

the subject has a hemophilia or other bleeding disorder or condition, and is undergoing surgery;

a dose of the modified FVIIa is administered to the subject at least 3 hours or 2 hours before surgery; and then a dose of the modified FVIIa is subcutaneously administered 2 to 3 hours after surgery;

the modified FVIIa is optionally administered again after another 2 to 3 hours; and the modified FVIIa is administered once or twice a day thereafter until the subject is healed or the cause of the bleeding is corrected.

Embodiment I-8. The method of any of embodiments I-1 to I-5, wherein:

the subject has a hemophilia or other bleeding disorder or condition, and is undergoing surgery;

a dose of the modified FVIIa is subcutaneously administered every 4 to 6 hours after surgery until bleeding stops or the subject is healed or the cause of the bleeding is corrected.

Embodiment I-9. The method of any of embodiments I-1 to I-5, wherein the bleeding is due to surgery or trauma.

Embodiment I-10. The method of any of embodiments I-1 to I-5, wherein the bleeding is manifested as acute hemarthroses, singular hemarthrosis, chronic hemophilic arthropathy, hematoma, hematuria, central nervous system bleeding, gastrointestinal bleeding, bleeding into airways, oral bleeding, spontaneous bleeds, joint bleeds or cerebral hemorrhage.

Embodiment I-11. The method of any of embodiments I-1 to I-5, wherein the bleeding is due to dental extraction or bleeding gums.

Embodiment I-12. The method of any of embodiments I-1 to I-5, wherein the bleeding is surgical.

Embodiment I-13. The method of any of embodiments I-1 to I-5, wherein:

the bleeding is surgical; and the surgery is joint surgery, limb surgery, heart surgery, angioplasty, upper airway surgery, lung surgery, abdominal surgery, spinal surgery, brain surgery, joint replacement, vascular surgery, dental surgery, or organ transplant surgery.

Embodiment I-14. The method of embodiment I-12, wherein the surgery is transplant surgery selected from among transplantation of bone marrow, heart, lung, pancreas, and liver.

Embodiment I-15. The method of embodiment I-12, wherein the surgery is hip or knee replacement or arthrodesis.

Embodiment I-16. The method of any of embodiments I-1 to I-15, wherein the bleeding is acute and results from trauma or surgery or the episodic bleeding is menstrual bleeding or joint bleeding or target joint bleeding or a surgical wound that is healed or corrected.

Embodiment I-17. The method of embodiment I-16, wherein administration is every 2-4 hours or 3-6 hours or 4-6 hours.

Embodiment I-18. The method of any of embodiments I-1 to I-17, wherein:

the bleed is episodic or predictable; and the subject is pre-treated prior to the bleeding.

Embodiment I-19. The method of embodiment I-18, wherein pre-treatment is effected about 4 hours or less before the bleed.

Embodiment I-20. The method of embodiment I-19, wherein pre-treatment is effected about 3 hours or less, or 2 hours or less, or 1 hour or less before the bleeding.

Embodiment I-21. The method of embodiment I-19, wherein pre-treatment is effected at least 15 minutes before the bleeding.

Embodiment I-22. The method of any of embodiments I-1 to I-21, wherein the bleeding is the result of surgery.

Embodiment I-23. The method of any of embodiments I-1 to I-21, wherein the bleeding is the result of a trauma or injury.

Embodiment I-24. The method of any of embodiments I-1 to I-21, wherein the bleeding is from a wound.

Embodiment I-25. The method of any of embodiments I-1 to I-21, wherein the bleeding is menstrual bleeding or is a joint bleed.

Embodiment I-26. The method of any of embodiments I-1 to I-25, wherein one dose of the modified FVIIa is subcutaneously administered.

Embodiment I-27. The method of any of embodiments I-1 to I-25, wherein the modified FVIIa is administered a plurality of times until the bleeding stops or any wound is healed or bleeding is corrected.

Embodiment I-28. The method of any of embodiments I-1 to I-27, wherein a dose or doses of the modified FVIIa is/are administered subcutaneously before the bleeding.

Embodiment I-29. The method of any of embodiments I-1 to I-28, wherein a dose or doses of the modified FVIIa is administered subcutaneously after the bleeding starts.

Embodiment I-30. The method of any of embodiments I-1 to I-29, wherein a dose of the modified FVIIa is administered within 1 minute up to 2 hours from the start of the bleeding.

Embodiment I-31. The method of any of embodiments I-1 to I-30, wherein the modified FVIIa is administered subcutaneously a plurality of times until the bleeding stops or the wound heals or bleeding is corrected.

Embodiment I-32. The method of any of embodiments I-1 to I-31, wherein a single dose of modified FVIIa is from about 10 µg/kg to 500 µg/kg, or 15 µg/kg to 400 µg/kg, or 15 µg/kg to 350 µg/kg, or 20 µg/kg to 400 µg/kg, or 20 mg/kg to 350 µg/kg, or 30 µg/kg to 350 µg/kg, or 25 µg/kg to 350 µg/kg, based on the weight of the treated subject.

Embodiment I-33. The methods of any of embodiments I-1 to I-32, wherein a single subcutaneous dose is 60-120 µg/kg, based on the weight of the treated subject.

Embodiment I-34. The method of any of embodiments I-1 to I-33, where a single subcutaneous dose of the modified FVIIa is 10 to 500 µg/kg, 30 to 300 µg/kg, or 60 to 120 µg/kg, based on the weight of the subject treated.

Embodiment I-35. The method of any of embodiments I-1 to I-34, wherein a single dose of modified FVIIa is from about 10 µg/kg to 500 µg/kg, or 15 µg/kg to 400 µg/kg, or 15 µg/kg to 350 µg/kg, or 20 µg/kg to 400 µg/kg, or 20 mg/kg to 350 µg/kg, or 30 µg/kg to 350 µg/kg, or 25 µg/kg to 350 µg/kg per dose.

Embodiment I-36. The method of any of embodiments I-1 to I-35, wherein a single subcutaneous dose of the modified FVIIa is in a volume of 10 mL or less or 5 mL or less.

Embodiment I-37. The method of any of embodiments I-1 to I-36, wherein a single subcutaneous dose of the modified FVIIa is in a volume of 1 mL to 2 mL, or 1.25 mL to 1.5 mL, or 1 mL to 10 mL.

Embodiment I-38. The method of any of embodiments I-1 to I-37, further comprising administering an additional coagulant treatment or factor.

Embodiment I-39. The method of any of embodiments I-1 to I-38, wherein the treatment comprises administration of antibody emicizumab-kxwh and/or a factor eight inhibitor bypass activity product.

Embodiment I-40. The method of embodiment I-39, wherein the additional coagulation factor is selected from among one or more of plasma purified or recombinant coagulation factors, procoagulants, such as vitamin K, vitamin K derivative and protein C inhibitors, plasma, platelets, red blood cells and corticosteroids.

Embodiment I-41. The method of any of embodiments I-1 to I-40, wherein the subject has a hemophilia.

Embodiment I-42. The method of any of embodiments I-1 to I-40, wherein the subject has a disease or condition selected from among blood coagulation disorders, hematologic disorders, hemorrhagic disorders, hemophilias, and other bleeding disorders.

Embodiment I-43. The method of any of embodiments I-1 to I-40, wherein the subject has hemophilia A, hemophilia B, hemophilia A with inhibitors, hemophilia B with inhibitors, Factor VII deficiency, Glanzmann thrombasthenia, acquired hemophilia, or is taking anti-coagulant therapy.

Embodiment I-44. The method of embodiment I-41, wherein the subject has a hemophilia; and the hemophilia is selected from among hemophilia A, hemophilia B and hemophilia C, hemophilia A with inhibitors, and hemophilia B with inhibitors.

Embodiment I-45. The method of embodiment I-41, wherein the hemophilia is congenital.

Embodiment I-46. The method of embodiment I-41, wherein the hemophilia is acquired.

Embodiment I-47. The method of embodiment I-41, wherein the subject has autoantibodies to factor VIII or factor IX.

Embodiment I-48. The method of any of embodiments I-1 to I-47, wherein the subject has been receiving oral anticoagulant therapy.

Embodiment I-49. The method of embodiment I-48, wherein the oral anticoagulant therapy comprises one or more of heparin, dabigatran, rivaroxaban, apixaban, bemiparin, nadroparin, reviparin, enoxaparin, parnaparin, certoparin, dalteparin, and tinzaparin.

Embodiment I-50. The method of any of embodiments I-1 to I-49, wherein the modified FVIIa has a potency greater than the FVIIa of SEQ ID NO: 3.

Embodiment I-51. The method of any of embodiments I-1 to I-49, wherein the modified FVIIa has increased coagulant activity, compared to wild-type FVIIa of SEQ ID NO: 3, in the absence of tissue factor.

Embodiment I-52. The method of any of embodiments I-1 to I-49, wherein the modified FVIIa has increased coagulant activity in the presence of tissue factor.

Embodiment I-53. The method of any of embodiments I-1 to I-52, wherein the modified FVIIa has $k_{cat}/k_m$ in a tissue-factor dependent assay that is greater than 100%, 150%, 200%, or 250% or more than unmodified FVIIa (SEQ ID NO: 3) in the same assay.

Embodiment I-54. The method of any of embodiments I-1 to I-53, wherein the modified FVIIa has coagulation activity that is at least 1.5 times the activity of unmodified FVIIa of SEQ ID NO: 3 in the same assay.

Embodiment I-55. The method of any of embodiments I-1 to I-54, wherein the modified FVIIa has potency at least 3 times that of the unmodified FVIIa of SEQ ID NO: 3.

Embodiment I-56. The method of any of embodiments I-1 to I-55, wherein the modified FVIIa has potency at least 4 times that of the unmodified FVIIa of SEQ ID NO: 3.

Embodiment I-57. The method of any of embodiments I-1 to I-56, wherein the modified FVIIa has potency at least 5 times that of the unmodified FVIIa of SEQ ID NO: 3.

Embodiment I-58. The method of any of embodiments I-1 to I-57, wherein the FVIIa has increased potency as assessed by activated partial thromboplastin time (aPTT) and/or thromboelastography (TEG) or any assay that assesses thrombin generation.

Embodiment I-59. The method of any of embodiments I-1 to I-58, wherein coagulation activity of the modified FVIIa polypeptide is at least 110%, 150%, 200%, 250%, 300%, 400%, 500% or more of the coagulation activity of the unmodified FVIIa polypeptide of SEQ ID NO: 3.

Embodiment I-60. The method of any of embodiments I-1 to I-59, wherein the modified FVIIa has increased serum half-life or an increased terminal elimination half-life compared to the unmodified FVIIa.

Embodiment I-61. The method of any of embodiments I-1 to I-60, wherein:
the modified FVIIa polypeptide comprises amino acid replacements at positions corresponding to positions 286 and 298 in a FVIIa polypeptide having the sequence of amino acids set forth in SEQ ID NO: 3;
the amino acid replacement at position 286 is Arg (R), and the amino acid replacement at position 298 is Gln (Q);
the modified FVIIa polypeptide, when in an activated form, exhibits procoagulant activity; and
the amino acid sequence of the modified FVIIa polypeptide has at least 90% sequence identity with a polypeptide having the sequence of amino acids set forth in any of SEQ ID NOs:1-3.

Embodiment I-62. The method of any of embodiments I-1 to I-61, wherein the modified FVIIa polypeptide comprises the amino acid replacements Q286R/M298Q with reference to SEQ ID NO: 3.

Embodiment I-63. The method of any of embodiments I-1 to I-62, wherein:
the modified FVIIa polypeptide comprises an amino acid replacement at the position corresponding to position 286 in a FVIIa polypeptide having the sequence of amino acids set forth in SEQ ID NO: 3;
the amino acid replacement at position 286 is Arg (R);
the modified FVIIa polypeptide, when in an activated form, exhibits procoagulant activity greater than a FVIIa polypeptide having the primary amino acid sequence set forth in SEQ ID NO: 3; and
the modified FVIIa polypeptide comprises up to a total of 2, 3, 4, 5, 6, or 7 amino acid replacements, insertions or deletions compared to the polypeptide having the sequence of amino acids set forth in SEQ ID NO: 3.

Embodiment I-64. The method of any of embodiments I-1 to I-62, wherein:

the modified FVIIa polypeptide comprises amino acid replacements at positions corresponding to positions 286 and 298 in a FVIIa polypeptide having the sequence of amino acids set forth in SEQ ID NO: 3;
the amino acid replacement at position 286 is Arg (R), and the amino acid replacement at position 298 is Gln (Q);
the modified FVIIa polypeptide, when in an activated form, exhibits procoagulant activity; and
the modified FVIIa polypeptide comprises up to a total of 2, 3, 4, 5, 6, 7, 8, 9, 10, 11, 12, 13, 14, 15, 16, 17, 18, 19, or 20 amino acid replacements, insertions or deletions compared to the polypeptide having the sequence of amino acids set forth in SEQ ID NO: 3.

Embodiment I-65. The method of any of embodiments I-1 to I-64, wherein the modified FVIIa polypeptide comprises amino acid replacements at positions corresponding to positions 128, 129, 286 and 298 in a FVIIa polypeptide having the sequence of amino acids set forth in SEQ ID NO: 3, wherein:

the amino acid replacement at the position corresponding to position 128 is Asn (N), position 129 is Ala (A), position 286 is Arg (R), and position 298 is Gln (Q);

the amino acid sequence of the unmodified FVIIa polypeptide comprises the polypeptide of SEQ ID NO.3;

the corresponding positions in the modified FVIIa polypeptide are identified by alignment of the amino acid sequence of the modified FVIIa polypeptide with the amino acid sequence set forth in SEQ ID NO: 3; and the modified FVIIa polypeptide, when in its activated form, exhibits procoagulant activity greater than the FVIIa polypeptide of SEQ ID NO: 3.

Embodiment I-66. The method of any of embodiments I-1 to I-65, wherein the modified FVIIa polypeptide comprises a modification or modifications that add a glycosylation site or sites.

Embodiment I-67. The method of embodiment I-66, wherein the modification(s) that add a glycosylation site or sites is/are introduced by amino acid replacements selected from among T128N/P129A, E394N/P395A/R396S, G318N, K109N, A122N/G124S, A51N, T130N/E132S, A122N/G124S/E394N/P395A/R396S, S119N/L121S, K109N/A175S, S119N/L121S/A175S, T128N/P129A/A175S and A122N/G124S/A175S with reference to SEQ ID NO: 3.

Embodiment I-68. The method of embodiment I-66, wherein the glycosylation site or sites is/are introduced by modification(s) selected from among S52A, 560A, E394N/P395A/R396S, R2025, A292N/A294S, G318N, A175S, K109N, A122N/G124S, A51N, T130N/E132S, A122N/G124S/E394N/P395A/R396S, A122N/G124S/394N/P395A/R396S/G318N, S52A/S60A, S52N/P54S, S119N/L121S, T128N/P129A, Q66N/Y68S, S52N/P54S/A122N/G124S/E394N/P395A/R396S, K109N/A292N/A294S, K109N/A175S, S119N/L121S/A175S, T128N/P129A/A175S and A122N/G124S/A175S with reference to SEQ ID NO: 3.

Embodiment I-69. The method of any of embodiments I-1 to I-66, wherein the glycosylation site is introduced by the modification A122N/G124S.

Embodiment I-70. The method of any of embodiments I-1 to I-69, wherein the modified FVIIa comprises the modification(s) selected from among Q286R, Q286R/H257A, Q286R/S222A, Q286R/S222A/H257A, Q286R/S222A/Gla Swap FIX, Q286R/H257A/Gla Swap FIX, Q286R/S222A/H257A/Gla Swap FIX, Q286R/Q366V, A175S/Q286R/Q366V, S222A/Q286R/Q366V, H257S/Q286R, H257S/Q286R/Q366V, S222A/H257A/Q286R/Q366V, Q286R/H373A, Q286R/K341D, Q286R/Q366D, Q286R/Q366N, Q286R/H373F, S52A/S60A/Q286R, S52A/S60A/Q286R/H373F, T239V/Q286R, T239V/Q286R/H373F, T2391/Q286R/H373F and A122N/G124S/A175S/Q286R, with reference to SEQ ID NO: 3.

Embodiment I-71. The method of any of embodiments I-1 to I-70, wherein the modified FVIIa comprises an amino acid replacement at a position corresponding to a position in SEQ ID NO: 3 selected from among 51, 52, 54, 60, 66, 68, 109, 119, 122, 124, 130, 132, 158, 161, 175, 196, 197, 199, 202, 216, 222, 237, 239, 257, 287, 290, 292, 294, 296, 298, 305, 314, 318, 321, 337, 341, 366, 373, 374, 394, 395 and 396.

Embodiment I-72. The method of any of embodiments I-1 to I-71, wherein the FVIIa polypeptide comprises the replacements T128N/P129A/Q286R/M298Q, with reference to SEQ ID NO: 3.

Embodiment I-73. The method of any of embodiments I-1 to I-72, wherein the modified FVIIa polypeptide comprises additional amino acid replacement(s) selected from among replacements corresponding to T239V, Q366N and H373F.

Embodiment I-74. The method of any of embodiments I-1 to I-73, wherein the modified FVIIa polypeptide comprises the sequence of amino acids set forth in any of SEQ ID NOS: 138, 155, 280, 288, 337, 338, 356 and 367.

Embodiment I-75. The method of embodiment I-74, wherein the primary sequence of the modified FVIIa polypeptide consists of the sequence set forth in SEQ ID NO: 280.

Embodiment I-76. The method of any of embodiments I-1 to I-73, wherein the modified FVIIa polypeptide is two-chain activated Factor VII (FVIIa) polypeptide consisting of the amino acid sequence of SEQ ID NO: 280 cleaved between the arginine at position 152 and the isoleucine at position 153.

Embodiment I-77. The method of embodiment I-76, wherein the first and second chains are linked by a least one disulfide bridge.

Embodiment I-78. The method of any of embodiments I-1 to I-77, wherein the modified FVIIa polypeptide has at least 90% amino acid sequence identity to SEQ ID NO: 280, wherein the amino acids corresponding to positions 128, 129, 286 and 298 of SEQ ID NO: 280 are invariant.

Embodiment I-79. The method of any of embodiments I-1 to I-77, wherein the first and second chains of the two-chain polypeptide consist respectively of amino acids 1-152 and 153-406 of SEQ ID NO: 280.

Embodiment I-80. The method of any of embodiments I-1 to I-74, wherein the modified FVIIa polypeptide comprises amino acid replacements selected from among replacements corresponding to Q286R/M298Q/Q366N, T128N/P129A/Q286R/M298Q, V158D/Q286R/E296V/M298Q, S222A/H257A/Q286R/M298Q, T128N/P129A/S222A/H257A/Q286R/M298Q, T128N/P129A/Q286R/M298Q/H373F, T128N/P129A/A175S/Q286R/M298Q, A122N/G124S/A175S/Q286R/M298Q, T128N/P129A/Q286R/M298Q/Q366N, V158D/Q286R/E296V/M298Q and T128N/P129A/T239V/Q286R/M298Q, with reference to SEQ ID NO: 3.

Embodiment I-81. The method of any of embodiments I-1 to I-74, wherein the modified FVIIa polypeptide comprises modifications in a FVIIa polypeptide selected from among Q286R/Gla Swap FIX, Q286R/H257A, Q286R/S222A, Q286R/S222A/H257, Q286R/S222A/Gla Swap FIX, Q286R/H257A/Gla Swap FIX, Q286R/S222A/H257A/Gla Swap FIX, Q286R/M298Q, Q286R/M298Q/K341Q, Q286R/M298Q/K199E, Q286R/M298Q/Gla Swap FIX, Q286R/Q366V, Q286R/A292N/A294S/Q366V, A175S/Q286R/Q366V, S222A/Q286R/Q366V, H257S/Q286R, H257S/Q286R/Q366V, S222A/H257A/Q286R/Q366V, Q286R/H373A, S222A/H257A/Q286R/M298Q, V158D/ E296V/M298Q, Gla Swap FME4OL/Q286R/M298Q, {Gla Swap FMK43I}/Q286R/M298Q, {Gla Swap FIX/ Q44S}/Q286R/M298Q, {Gla Swap FIX/M19K}/Q286R/ M298Q, {Gla Swap FIX/M19K/E4OL/K43I/Q44S}/ Q286R/M298Q, T128N/P129A/Q286R, T128N/P129A/ Q286R/M298Q, T128N/P129A/Q286R/H373F, V158D/ Q286R/E296V/M298Q, Gla Swap FIX/T128N/P129A/ S222A/Q286R, Gla Swap FIX/T128N/P129A/Q286R/ M298Q, T128N/P129A/S222A/H257A/Q286R/M298Q, T128N/P129A/Q286R/M298Q/H373F, S52A/S60A/ Q286R, Gla Swap FIX/S52A/S60A/S222A/Q286R, S52A/ S60A/Q286R/M298Q, Gla Swap FIX/S52A/S60A/Q286R/ M298Q, S52A/S60A/S222A/H257A/Q286R/M298Q, S52A/S60A/Q286R/H373F/, S52A/S60A/Q286R/M298Q/ H373F, T239V/Q286R, Gla Swap FIX/S222A/T239V/ Q286R, T239V/Q286R/M298Q, S222A/T239V/H257A/ Q286R/M298Q, Gla Swap FIX/T239V/Q286R/M298Q, T239V/Q286R/H373F, T239V/Q286R/M298Q/H373F, T239I/Q286R, Gla Swap FIX/S222A/T239I/Q286R, T239I/ Q286R/M298Q, S222A/T239I/H257A/Q286R/M298Q, Gla Swap FIX/T239I/Q286R/M298Q, T239I/Q286R/H373F, T239I/Q286R/M298Q/H373F, Gla Swap FIX/S222A/ Q286R/H373F, Gla Swap FIX/S222A/Q286R/M298Q, Gla Swap FIX/S222A/Q286R/M298Q/H373F, V158D/Q286R/ E296V/M298Q/H373F, H257A/Q286R/M298Q, H257S/ Q286R/M298Q, Gla Swap FIX/S222A/H257S/Q286R/, S222A/H257S/Q286R/M298Q, H257S/Q286R/M298Q/ H373F, S222A/Q286R/M298Q/H373F, S222A/Q286R/ M298Q, T128N/P129A/A175S/Q286R, A122N/G124S/ A175 S/Q286R, Gla Swap FIX/T128N/P129A/A175S/ S222A/Q286R, Gla Swap FIX/A122N/G124S/A175S/ S222A/Q286R, T128N/P129A/A175S/Q286R/M298Q, A122N/G124S/A175S/Q286R/M298Q, T128N/P129A/ A175S/S222A/H257A/Q286R/M298Q, A122N/G1245/ A175S/5222A/H257A/Q286R/M298Q, T128N/P129A/A175S/Q286R/M298Q/H373F, A122N/G124S/A175S/Q286R/M298Q/H373F, {Gla Swap FIX/K43I}/T128N/P129A/Q286R/M298Q, T128N/P129A/Q286R/M298Q/Q366N, {Gla Swap FIX/K43I}/Q286R/M298Q/Q366N, {Gla Swap FIX/K43I}/T128N/P129A/Q286R/M298Q/Q366N, V158D/Q286R/E296V/M298Q, T128N/P129A/Q286R/M298Q/Q366N/H373F, T239V/Q286R/M298Q/Q366N, T239I/Q286R/M298Q/Q366N, T128N/P129A/T239V/Q286R/M298Q, T128N/P129A/S222A/T239V/H257A/Q286R/M298Q, T128N/P129A/T239V/Q286R/M298Q/H373F, T128N/P129A/T239I/Q286R/M298Q and T128N/P129A/T239I/Q286R/M298Q/H373F, with reference to SEQ ID NO: 3.

Embodiment I-82. The method of any of embodiments I-1 to I-74, wherein the modified FVIIa comprises one or more amino acid modification(s) selected from among S279C/V302C, L280C/N301C, V281C/V302C, S282C/V299C, insertion of a tyrosine at position 4, F4S, F4T, P10Q, P10E, P10D, P10N, Q21N, R28F, R28E, I30C, I30D, I30E, K32D, K32Q, K32E, K32G, K32H, K32T, K32C, K32A, K32S, D33C, D33F, D33E, D33K, A34C, A34E, A34D, A34I, A34L, A34M, A34V, A34F, A34W, A34Y, R36D, R36E, T37C, T37D, T37E, K38C, K38E, K38T, K38D, K38L, K38G, K38A, K38S, K38N, K38H, L39E, L39Q, L39H, W41N, W41C, W41E, W41D, I42R, I42N, I42S, I42A, I42Q, I42N, I42S, I42A, I42Q, I42K, S43Q, S43N, Y44K, Y44C, Y44D, Y44E, S45C, S45D, S45E, D46C, A51N, S53N, G58N, G59S, G59T, K62E, K62R, K62D, K62N, K62Q, K62T, L65Q, L65S, L65N, F71D, F71Y, F71E, F71Q, F71N, P74S, P74A, A75E, A75D, E77A, E82Q, E82N, E82S, E82T T83K, N95S, N95T, G97S, G97T, Y101N, D104N, T106N, K109N, E116D, G117N, G124N, S126N, T128N, L141C, L141D, L141E, E142D, E142C, K143C, K143D, K143E, R144E, R144C, R144D, N145Y, N145G, N145F, N145M, N145S, N145I, N145L, N145T, N145V, N145P, N145K, N145H, N145Q, N145E, N145R, N145W, N145D, N145C, K157V, K157L, K157I, K157M, K157F, K157W, K157P, K157G, K157S, K157T, K157C, K157Y, K157N, K157E, K157R, K157H, K157D, K157Q, V158L, V158I, V158M, V158F, V158W, V158P, V158G, V158S, V158T, V158C, V158Y, V158N, V158E, V158R, V158K, V158H, V158D, V158Q, A175S, A175T, G179N, I186S, I186T, V188N, R202S, R202T, I205S, I205T, D212N, E220N, I230N, P231N, P236N, G237N, Q250C, V253N, E265N, T267N, E270N, A274M, A274L, A274K, A274R, A274D, A274V, A274I, A274F, A274W, A274P, A274G, A274T, A274C, A274Y, A274N, A274E, A274H, A274S, A274Q, F275H, R277N, F278S, F278A. F278N, F278Q, F278G, L280N, L288K, L288C, L288D, D289C, D289K, L288E, R290C, R290G, R290A, R290S, R290T, R290K, R290D, R290E, G291E, G291D, G291C, G291N, G291K, A292C, A292K, A292D, A292E, T293K, E296V, E296L, E296I, E296M, E296F, E296W, E296P, E296G, E296S, E296T, E296C, E296Y, E296N, E296K, E296R, E296H, E296D, E296Q, M298Q, M298V, M298L, M298I, M298F, M298W, M298P, M298G, M298S, M298T, M298C, M298Y, M298N, M298K, M298R, M298H, M298E, M298D, P303S, P303T, R304Y, R304F, R304L, R304M, R304G, R304T, R304A, R304S, R304N, L305V, L305Y, L305I, L305F, L305A, L305M, L305W, L305P, L305G, L305S, L305T, L305C, L305N, L305E, L305K, L305R, L305H, L305D, L305Q, M306D, M306N, D309S, D309T, Q312N, Q313K, Q313D, Q313E, S314A, S314V, S314I, S314M, S314F, S314W, S314P, S314G, S314L, S314T, S314C, S314Y, S314N, S314E, S314K, S314R, S314H, S314D, S314Q, R315K, R315G, R315A, R315S, R315T, R315Q, R315C, R315D, R315E, K316D, K316C, K316E, V317C, V317K, V317D, V317E, G318N, N322Y, N322G, N322F, N322M, N322S, N322I, N322L, N322T, N322V, N322P, N322K, N322H, N322Q, N322E, N322R, N322W, N322C, G331N, Y332S, Y332A, Y332N, Y332Q, Y332G, D334G, D334E, D334A, D334V, D334I, D334M, D334F, D334W, D334P, D334L, D334T, D334C, D334Y, D334N, D334K, D334R, D334H, D334S, D334Q, S336G, S336E, S336A, S336V, S336I, S336M, S336F, S336W, S336P, S336L, S336T, S336C, S336Y, S336N, S336K, S336R, S336H, S336D, S336Q, K337L, K337V, K337I, K337M, K337F, K337W, K337P, K337G, K337S, K337T, K337C, K337Y, K337N, K337E, K337R, K337H, K337D, K337Q, K341E, K341Q, K341G, K341T, K341A, K341S, G342N, H348N, R353N, Y357N, I361N, F374P, F374A, F374V, F374I, F374L, F374M, F374W, F374G, F374S, F374T, F374C, F374Y, F374N, F374E, F374K, F374R, F374H, F374D, F374Q, V376N, R379N, L390C, L390K, L390D, L390E, M391D, M391C, M391K, M391N, M391E, R392C, R392D, R392E, S393D, S393C, S393K, S393E, E394K, P395K, E394C, P395D, P395C, P395E, R396K, R396C, R396D, R396E, P397D, P397K, P397C, P397E, G398K, G398C, G398D, G398E, V399C, V399D, V399K, V399E, L400K, L401K, L401C, L401D, L401E, R402D, R402C, R402K, R402E, A403K, A403C, A403D, A403E, P404E, P404D, P404C, P404K, F405K, P406C, K32N/A34S, K32N/A34T, F31N/D33S, F31N/D33T, I30N/K32S, I30N/K32T, A34N/R36S, A34N/R36T, K38N/F40S, K38N/F40T, T37N/L39S, T37N/L39T, R36N/K38S, R36N/K38T, L39N/W41S, L39N/W41T, F4ON/I42S, F4ON/I42T, I42N/Y44S, I42N/Y44T, Y44N/D46S, Y44N/D46T, D46N/D48S, D46N/D48T, G47N/Q49S, G47N/Q49T, K143N/N145S, K143N/N145T, E142N/R144S, E142N/R144T, L141N/K143S, L141N/K143T, I140N/E142S, I140N/E142T, R144N/A146S, R144N/A146T, A146N/K148S, A146N/K148T, S147N/P149S/, S147N/P149T, R290N/A292S, R290N/A292T, D289N/G291S, D289N/G291T, L288N/R290S, L288N/R290T, L287N/D289S, L287N/D289T, A292N/A294S, A292N/A294T, T293N/L295S, T293N/L295T, R315N/V317S, R315N/V317T, S314N/K316S, S314N/K316T, Q313N/R315S, Q313N/R315T, K316N/G318S, K316N/G318T, V317N/D319S, V317N/D319T, K341N/D343S, K341N/D343T, S339N/K341S, S339N/K341T, D343N/G345S, D343N/G345T, R392N/E394S, R392N/E394T, L390N/R392S, L390N/R392T, K389N/M391S, K389N/M391T, S393N/P395S, S393N/P395T, E394N/R396S, E394N/R396T, P395N/P397S, P395N/P397T, R396N/G398S, R396N/G398T, P397N/V399S, P397N/V399T, G398N/L400S, G398N/L400T, V399N/L401S, V399N/L401T, L400N/R402S, L400N/R402T, L401N/A403S, L401N/A403T, R402N/P404S, R402N/P404T, A403N/F405S, A403N/F405T, P404N/P406S and P404N/P406T, with reference to SEQ ID NO: 3.

Embodiment I-83. The method of any of embodiments I-1 to I-82, wherein the modified FVIIa polypeptide comprises one or more modifications selected from among D196K, D196R, D196A, D196Y, D196F, D196W, D196L, D196I, K197Y, K197A, K197E, K197D, K197L, K197M, K197I, K197V, K197F, K197W, K199A, K199D, K199E, G237W, G237T, G237I, G237V, T239A, R290A, R290E, R290D, R290N, R290Q, R290K, R290M, R290V, K341E, K341R, K341Q, K341N, K341M, K341D, G237T238insA, G237T238insS, G237T238insV, G237T238insAS, G237T238insSA, D196K197insK, D196K197insR, D196K197insY, D196K197insW, D196K197insA, D196K197insM, K197I198insE, K197I198insY, K197I198insA, K197I198insS, T239S, T239N, T239Q, T239V, T239L, T239H, T239I, L287T, P321K, P321E, P321Y, P321S, Q366D, Q366E, Q366N, Q366T, Q366S, Q366V, Q366I, Q366L, Q366M, H373D, H373E, H373S, H373F, H373A, K161S, K161A, K161V, H216S, H216A, H216K, H216R, S222A, S222K, S222V, S222N, S222E, S222D, H257A, H257S, Gla Swap FIX, {Gla Swap FME40L}, {Gla Swap FIX/K43I}, {Gla Swap FIX/Q44S}, {Gla Swap FMM19K}, {Gla Swap FIX/M19K/E40L/K43I/Q44S}, Gla Swap FX, Gla Swap Prot C, Gla Swap Prot S, Gla Swap Thrombin, S52A, 560A, E394N, P395A, R396S, R202S, A292N, A294S, G318N, A175S, K109N, A122N, G124S, A51N, T130N, E132S, S52N, P54S, S119N, L121S, T128N, P129A, Q66N, Y68S, S103S111delinsQRLMEDICLPRWGCLWEDDF, H115 S126delinsQRLMEDICLPRWGCLWEDDF, T128P134delinsQRLMEDICLPRWGCLWEDDF, S103S111delinsIEDICLPRWGCLWE, H115 S126delinsIEDICLPRWGCLWE, T128P134delinsIEDICLPRWGCLWE, S103S111delinsDICLPRWGCLWED, H115 S126delinsDICLPRWGCLWED, T128P134delinsDICLPRWGCLWED, P406insIEDICLPRWGCLW, P406insGGGSIEDICLPRWGCLW, P406insDICLPRWGCLW, P406insGGGSDICLPRWGCLWED, S103 S111delins SFGRGDIRNV, H115S126delinsSFGRGDIRNV, T127P134delinsSFGRGDIRNV, P406insCSFGRGDIRNVC, P406insGGGSCSFGRGDIRNVC, V158T, V158D, L287T, E296V, M298K and M298Q, with reference to SEQ ID NO: 3.

Embodiment I-84. The method of any of embodiments I-1 to I-83, wherein the modified FVIIa polypeptide comprises one or more amino acid modification(s) that increases resistance to antithrombin-III, increases binding and/or affinity to phospholipids, increases affinity for tissue factor, increases intrinsic activity, increases TF-dependent activity, increases coagulant activity, alters the conformation of the polypeptide to alter zymogenicity, increases catalytic or coagulant activity by shifting the equilibrium between highly active and less active FVIIa conformations in favor of the highly active conformations, increases resistance to proteases, decreases glycosylation, increases glycosylation, reduces immunogenicity, increases stability, and/or facilitates chemical group linkage.

Embodiment I-85. The method of any of embodiments I-1 to I-84, wherein the primary sequence of the unmodified FVIIa polypeptide comprises the sequence of amino acids set forth in SEQ ID NO: 3.

Embodiment I-86. The method of any of embodiments I-1 to I-84, wherein the primary sequence of the unmodified FVIIa polypeptide consists of the sequence of amino acids set forth in SEQ ID NO: 3.

Embodiment I-87. The method of any of embodiments I-1 to I-86, wherein the modified FVIIa polypeptide is post-translationally modified.

Embodiment I-88. The method of embodiment I-87, wherein the post-translational modification comprises glycosylation.

Embodiment I-89. The method of embodiment I-88, wherein a post-translational modification is O-linked glycosylation.

Embodiment I-90. The method of embodiment I-88 or I-89, wherein a post-translational modification is N-linked glycosylation.

Embodiment I-91. The method of any of embodiments I-87 to I-90, wherein a post-translational modification is carboxylation of glutamic acid to γ-carboxyglutamic acid.

Embodiment I-92. The method of any of embodiments I-87 to I-91, wherein a post-translational modification is hydroxylation of aspartic acid to β-hydroxyaspartic acid Embodiment I-93. The method of any of embodiments I-1 to I-92, wherein the modification(s) of the FVIIa polypeptide is/are an amino acid replacement, insertion, deletion, or combinations thereof.

Embodiment I-94. A pharmaceutical composition for single dosage subcutaneous administration, comprising a single therapeutically effective dose of a modified FVIIa in a pharmaceutically acceptable carrier for subcutaneous administration for on-demand treatment of a bleed.

Embodiment I-95. The pharmaceutical composition of embodiment I-94, wherein the modified FVIIa is as described in any of embodiments I-1 to I-93.

Embodiment I-96. The pharmaceutical composition of embodiment I-94 or I-95 for use in a method of any of embodiments I-1 to I-93.

Embodiment I-97. The pharmaceutical composition of any of embodiments I-94 to I-96, wherein the amount of modified FVIIa is from 100 µg to 35 mg in a volume of 1 ml to 10 ml.

Embodiment I-98. The pharmaceutical composition of any of embodiments I-94 to I-97, wherein the amount of modified FVIIa is from 500 µg to 25 mg in a volume of 1 ml to 10 ml.

Embodiment I-99. The pharmaceutical composition of any of embodiments I-94 to I-98, wherein the amount of modified FVIIa is from 50 µg to 40 mg in a volume of 0.1 ml to 10 ml.

Embodiment I-100. The pharmaceutical composition of any of embodiments I-94 to I-98, wherein the amount of modified FVIIa is from 1 mg to 10, 15, 20 or 25 mg in a volume of 0.5 ml to 10 ml.

Embodiment I-101. The pharmaceutical composition of any of embodiments I-94 to I-100 that is in a volume of 1 ml to 5 ml, or 1 ml to 3 ml, or 1 ml to 1.5 ml.

Embodiment I-102. A container, comprising the pharmaceutical composition of any of embodiments I-94 to I-101.

Embodiment I-103. The container of embodiment I-102 that is a syringe or injection pen.

Embodiment I-104. The container of embodiment I-102 or I-103, wherein the pharmaceutical composition is lyophilized.

Embodiment I-105. The container of any of embodiments I-102 to I-104 that comprises two chambers, wherein one chamber contains the lyophilized composition; and another chamber comprises vehicle for dissolving the lyophilized composition.

Embodiment I-106. A method of treating a bleed in a subject, comprising subcutaneous administration of the pharmaceutical composition of any of embodiments I-94 to I-101.

Embodiment I-107. The method of embodiment I-106, wherein the composition is administered within 1, 2, or 3 hours or within 15 minutes of the bleed.

Embodiment I-108. A modified FVIIa for use for treating a bleed by subcutaneous administration within 4, 3, 2, or 1 hour or less before or after the bleed, wherein the modified FVIIa has greater coagulation activity or potency than the unmodified FVIIa that has the primary amino acid sequence set forth in SEQ ID NO: 3.

Embodiment I-109. The modified FVIIa as described in any of embodiments I-1 to I-93.

Embodiment I-110. The modified FVIIa for use in any of the methods of any of embodiments I-1 to I-93, I-106 and I-107.

Embodiment I-111. The method of embodiment I-61, wherein the modified FVIIa comprises the amino acid sequence set forth in SEQ ID NO: 280 or SEQ ID NO: 138.

Embodiment I-112. The method of any one of embodiments I-1 to I-93, I-106, I-107, and I-111, wherein the subcutaneous administration of the modified FVIIa has increased terminal elimination half-life compared to an intravenous administration of the modified FVIIa.

Embodiment I-113. The method of embodiment I-112, wherein the modified FVIIa comprises the amino acid sequence set forth in SEQ ID NO: 280.

Embodiment I-114. The method of embodiment I-112, wherein the modified FVIIa comprises the amino acid sequence set forth in SEQ ID NO: 138.

Embodiment I-115. A method of treating a bleeding disorder in a subject in need thereof, comprising subcutaneously administering to the subject a dose of modified Factor VIIa (FVIIa),
wherein the modified FVIIa has an activity or potency greater than an unmodified FVIIa, as set forth in SEQ ID NO: 3; and
wherein a dose of the modified FVIIa is administered in a multiple dosing regimen.

Embodiment I-116. The method of embodiment I-115, wherein the multiple dosing regimen comprises at least two or at least three doses within a 24 hour period.

Embodiment I-117. The method of embodiment I-116, wherein at least one dose of the multiple dosing regimen comprises about 30, about 60, about 90, or about 120 µg/kg of body weight of the subject.

Embodiment I-118. The method of any one of embodiments I-116 to I-117, wherein each dose of the multiple dosing regimen is identical.

Embodiment I-119. The method of any one of embodiments I-116 to I-118, wherein the modified FVIIa comprises the amino acid sequence set forth in SEQ ID NO: 280.

Embodiment II-1. A method of treating a bleeding event in a subject, comprising subcutaneously administering to the subject a dose of a modified Factor VIIa comprising modifications at least at a position corresponding to position 286 and at a position corresponding to position 298 in a FVII polypeptide comprising the sequence of amino acids set forth in SEQ ID NO: 3 or in a corresponding residue in a FVII polypeptide, wherein:
the modification at position 286 is an amino acid replacement with Arg (R);
the modification at position 298 is an amino acid replacement with Gln (Q);
the subcutaneous administration of the modified FVIIa has increased activity or potency; and
a dose of the modified FVIIa is administered subcutaneously within about 5 or 4 or 3 or 2 or 1 or fewer hours or minutes before and/or after the bleeding event, whereby the amount of bleeding is reduced or stopped or the cause of the bleed is corrected or is healed.

Embodiment II-2. The method of embodiment II-1, the modified FVIIa further comprising a modification at a position corresponding to position 128 in the FVII polypeptide having the sequence of amino acids set forth in SEQ ID NO: 3, wherein:
the modification at position 128 is an amino acid replacement with Asn (N).

Embodiment II-3. The method of any one of embodiments II-1 to II-2, the modified FVIIa further comprising a modification at a position corresponding to position 129 and in the FVII polypeptide having the sequence of amino acids set forth in SEQ ID NO: 3, wherein:
the modification at position 129 is Ala (A).

Embodiment II-4. The method of any of embodiments II-1 to II-3, wherein the dose of the modified FVIIa is administered subcutaneously within about 5 or 4 or 3 or 2 or 1 or fewer hours or minutes after the bleeding event.

Embodiment II-5. The method of any of embodiments II-1 to II-3, wherein the dose of the modified FVIIa is administered subcutaneously within about 5 or 4 or 3 or 2 or 1 or fewer hours or minutes before the bleeding event.

Embodiment II-6. The method of embodiment II-5, wherein the dose of the modified FVIIa is administered subcutaneously within about 5 hours before the bleeding event.

Embodiment II-7. The method of embodiment II-5, wherein the dose of the modified FVIIa is administered subcutaneously within about 4 hours before the bleeding event.

Embodiment II-9. The method of embodiment II-5, wherein the dose of the modified FVIIa is administered subcutaneously within about 3 hours before the bleeding event.

Embodiment II-9. The method of embodiment II-5, wherein the dose of the modified FVIIa is administered subcutaneously within about 2 hours before the bleeding event.

Embodiment II-10. The method of embodiment II-5, wherein the dose of the modified FVIIa is administered subcutaneously within about 1 hour before the bleeding event.

Embodiment II-11. The method of embodiment II-4, wherein the dose of the modified FVIIa is administered subcutaneously within about 5 hours after the bleeding event.

Embodiment II-12. The method of embodiment II-4, wherein the dose of the modified FVIIa is administered subcutaneously within about 4 hours after the bleeding event.

Embodiment II-13. The method of embodiment II-4, wherein the dose of the modified FVIIa is administered subcutaneously within about 3 hours after the bleeding event.

Embodiment II-14. The method of embodiment II-4, wherein the dose of the modified FVIIa is administered subcutaneously within about 2 hours after the bleeding event.

Embodiment II-15. The method of embodiment II-4, wherein the dose of the modified FVIIa is administered subcutaneously within about 1 hour after the bleeding event.

Embodiment II-16. The method of embodiment II-5, wherein the dose of the modified FVIIa is administered subcutaneously within about 5 minutes before the bleeding event.

Embodiment II-17. The method of embodiment II-5, wherein the dose of the modified FVIIa is administered subcutaneously within about 4 minutes before the bleeding event.

Embodiment II-18. The method of embodiment II-5, wherein the dose of the modified FVIIa is administered subcutaneously within about 3 minutes before the bleeding event.

Embodiment II-19. The method of embodiment II-5, wherein the dose of the modified FVIIa is administered subcutaneously within about 2 minutes before the bleeding event.

Embodiment II-20. The method of embodiment II-5, wherein the dose of the modified FVIIa is administered subcutaneously within about 1 minute before the bleeding event.

Embodiment II-21. The method of embodiment II-4, wherein the dose of the modified FVIIa is administered subcutaneously within about 5 minutes after the bleeding event.

Embodiment II-22. The method of embodiment II-4, wherein the dose of the modified FVIIa is administered subcutaneously within about 4 minutes after the bleeding event.

Embodiment II-23. The method of embodiment II-4, wherein the dose of the modified FVIIa is administered subcutaneously within about 3 minutes after the bleeding event.

Embodiment II-24. The method of embodiment II-4, wherein the dose of the modified FVIIa is administered subcutaneously within about 2 minutes after the bleeding event.

Embodiment II-25. The method of embodiment II-4, wherein the dose of the modified FVIIa is administered subcutaneously within about 1 minute after the bleeding event.

Embodiment II-26. The method of any of embodiments II-1 to II-25, wherein a repeated subcutaneous dose of the modified FVIIa is administered subcutaneously every 3-7, 2-5, 4-6, or 4-12 hours until the bleeding stops, the cause is corrected, or any wound is healed or for 1 to 2, 3, 4, or 5 days.

Embodiment II-27. The method of any one of embodiments II-1 to II-25, wherein the dose of modified FVIIa is administered every 1, 2, 3, 4, 5, 6, 7, 8, 9, 10, 11, or 12 hours.

Embodiment II-28. The method of any of embodiments II-1 to II-27, wherein:
the bleeding is episodic or predictable by the subject; and
the subject is treated with a subcutaneous dose of the modified FVIIa before the bleeding starts.

Embodiment II-29. The method of any of embodiments II-1 to II-27, wherein:
the bleeding event results from trauma or injury; and
the subject is treated with a subcutaneous dose of the modified FVIIa 15 minutes, 1, 2, 3, or 4 hours after the bleeding event.

Embodiment II-30. The method of any of embodiments II-1 to II-29, wherein:
the subject has a hemophilia or other bleeding disorder or condition, and is undergoing surgery;
a dose of the modified FVIIa is subcutaneously administered 5, 4, 3, 2, 1 hours or less before surgery;
the subject is treated with a FVIIa intravenously during surgery; and
a dose of the modified FVIIa is subcutaneously administered at least one time following surgery until there is no bleeding and/or risk of bleeding or until the subject is healed or the cause is corrected.

Embodiment II-31. The method of any of embodiments II-1 to II-29, wherein:
the subject has a hemophilia or other bleeding disorder or condition, and is undergoing surgery;
a dose of the modified FVIIa is administered to the subject at least 4 hours, or 3 hours, or 2 hours, or 1 hour before surgery;
a dose of the modified FVIIa is subcutaneously administered 2 to 3 hours after surgery;
the modified FVIIa is optionally administered again after another 2 to 3 hours; and
the modified FVIIa is administered once or twice a day thereafter until the subject is healed or the cause of the bleeding is corrected.

Embodiment II-32. The method of any of embodiments II-1 to II-29, wherein:
the subject has a hemophilia or other bleeding disorder or condition, and is undergoing surgery; and
a dose of the modified FVIIa is subcutaneously administered every 4 to 6 hours after surgery until bleeding stops or the subject is healed or the cause of the bleeding is corrected.

Embodiment II-33. The method of any of embodiments II-1 to II-29, wherein the bleeding is due to surgery or trauma.

Embodiment II-34. The method of any of embodiments II-1 to II-33, wherein the bleeding is manifested as acute hemarthroses, singular hemarthrosis, chronic hemophilic arthropathy, hematoma, hematuria, central nervous system bleeding, gastrointestinal bleeding, bleeding into airways, oral bleeding, spontaneous bleeds, joint bleeds, cerebral hemorrhage, or breakthrough bleeds.

Embodiment II-35. The method of any of embodiments II-1 to II-33, wherein the bleeding is due to dental extraction or bleeding gums.

Embodiment II-36. The method of any of embodiments II-1 to II-33, wherein the bleeding is surgical.

Embodiment II-37. The method of any of embodiments II-1 to II-33, wherein:
the bleeding is surgical; and
the surgery is joint surgery, limb surgery, heart surgery, angioplasty, upper airway surgery, lung surgery, abdominal surgery, spinal surgery, brain surgery, joint replacement, vascular surgery, dental surgery, or organ transplant surgery.

Embodiment II-38. The method of embodiment II-36, wherein the surgery is transplant surgery selected from among transplantation of bone marrow, heart, lung, pancreas, and liver.

Embodiment II-39. The method of embodiment II-36, wherein the surgery is hip or knee replacement or arthrodesis.

Embodiment II-40. The method of any of embodiments II-1 to II-39, wherein the bleeding is acute and results from trauma or surgery or the episodic bleeding is menstrual bleeding or joint bleeding or target joint bleeding or a surgical wound that is healed or corrected.

Embodiment II-41. The method of embodiment II-40, wherein administration is every 2-4 hours or 3-6 hours or 4-6 hours.

Embodiment II-42. The method of any of embodiments II-1 to II-41, wherein: the bleed is episodic or predictable; and the subject is pre-treated prior to the bleeding.

Embodiment II-43. The method of embodiment II-42, wherein pre-treatment is effected about 4 hours or less before the bleed.

Embodiment II-44. The method of embodiment II-43, wherein pre-treatment is effected about 3 hours or less, or 2 hours or less, or 1 hour or less before the bleeding.

Embodiment II-45. The method of embodiment II-43, wherein pre-treatment is effected at least 15 minutes before the bleeding.

Embodiment II-46. The method of any of embodiments II-1 to II-45, wherein the bleeding is the result of surgery.

Embodiment II-47. The method of any of embodiments II-1 to II-45, wherein the bleeding is the result of a trauma or injury.

Embodiment II-48. The method of any of embodiments II-1 to II-45, wherein the bleeding is from a wound.

Embodiment II-49. The method of any of embodiments II-1 to II-45, wherein the bleeding is menstrual bleeding or is a joint bleed.

Embodiment II-50. The method of any of embodiments II-1 to II-49, wherein the modified FVIIa is administered a plurality of times until the bleeding stops or any wound is healed or bleeding is corrected.

Embodiment II-51. The method of any of embodiments II-1 to II-50, wherein a dose or doses of the modified FVIIa is/are administered subcutaneously before the bleeding.

Embodiment II-52. The method of any of embodiments II-1 to II-51, wherein a dose or doses of the modified FVIIa is administered subcutaneously after the bleeding starts.

Embodiment II-53. The method of any of embodiments II-1 to II-52, wherein a dose of the modified FVIIa is administered within 1 minute up to 2 hours from the start of the bleeding.

Embodiment II-54. The method of any of embodiments II-1 to II-53, wherein the modified FVIIa is administered subcutaneously a plurality of times until the bleeding stops or the wound heals or bleeding is corrected.

Embodiment II-55. The method of any of embodiments II-1 to II-54, wherein a single dose of the modified FVIIa is from about 10 µg/kg to 30 µg/kg, 10 µg/kg to 60 µg/kg, 10 µg/kg to 90 µg/kg, 10 µg/kg to 120 µg/kg, 30 µg/kg to 60 µg/kg, 30 µg/kg to 90 µg/kg, 30 µg/kg to 120 µg/kg, 10 µg/kg to 500 µg/kg, or 15 µg/kg to 400 µg/kg, or 15 µg/kg to 350 µg/kg, or 20 µg/kg to 400 µg/kg, or 20 µg/kg to 350 µg/kg, or 30 µg/kg to 350 µg/kg, or 25 µg/kg to 350 µg/kg, based on the weight of the treated subject.

Embodiment II-56. The method of any of embodiments II-1 to II-55, wherein a single subcutaneous dose is about 60 to about 120 µg/kg, based on the weight of the treated subject.

Embodiment II-57. The method of any of embodiments II-1 to II-56, wherein a single subcutaneous dose is about 60 µg/kg, based on the weight of the treated subject.

Embodiment II-58. The method of any of embodiments II-1 to II-56, wherein a single subcutaneous dose of the modified FVIIa is 10 to 500 µg/kg, 30 to 300 µg/kg, or 60 to 120 µg/kg, based on the weight of the treated subject.

Embodiment II-59. The method of any of embodiments II-1 to II-57, wherein a single dose of modified FVIIa is from about 10 µg/kg to 500 µg/kg, or 15 µg/kg to 400 µg/kg, or 15 µg/kg to 350 µg/kg, or 20 µg/kg to 400 µg/kg, or 20 mg/kg to 350 µg/kg, or 30 µg/kg to 350 µg/kg, or 25 µg/kg to 350 µg/kg per dose.

Embodiment II-60. The method of any of embodiments II-1 to II-59, wherein a single subcutaneous dose of the modified FVIIa is in a volume of 10 mL or less or 5 mL or less.

Embodiment II-61. The method of any of embodiments II-1 to II-60, wherein a single subcutaneous dose of the modified FVIIa is in a volume of about 1 mL to 2 mL, or 1.25 mL to 1.5 mL, or 1 mL to 10 mL.

Embodiment II-62. The method of any of embodiments II-1 to II-61, further comprising administering an additional coagulant treatment or factor.

Embodiment II-63. The method of any of embodiments II-1 to II-62, wherein the treatment comprises administration of antibody emicizumab-kxwh and/or a factor eight inhibitor bypass activity product.

Embodiment II-64. The method of embodiment II-63, wherein the additional coagulation factor is selected from among one or more of plasma purified or recombinant coagulation factors, procoagulants, such as vitamin K, vitamin K derivative and protein C inhibitors, plasma, platelets, red blood cells and corticosteroids.

Embodiment II-65. The method of any of embodiments II-1 to II-64, further comprising administering an anti-tissue factor pathway inhibitor (TFPI) antibody.

Embodiment II-66. The method of embodiment II-65, wherein the anti-TFPI antibody is concizumab.

Embodiment II-67. The method of any of embodiments II-1 to II-66, further comprising administering an RNA interference (RNAi) therapeutic targeting antithrombin (AT).

Embodiment II-68. The method of embodiment II-67, wherein the RNAi therapeutic targeting AT is fitusiran.

Embodiment II-69. The method of any of embodiments II-1 to II-68, wherein the subject has a disease or condition selected from among blood coagulation disorders, hematologic disorders, hemorrhagic disorders, hemophilias, and other bleeding disorders.

Embodiment II-70. The method of any of embodiments II-1 to II-69, wherein the subject has hemophilia A, hemophilia B, hemophilia A with inhibitors, hemophilia B with inhibitors, Factor VII deficiency, Glanzmann thrombasthenia, acquired hemophilia, or is taking anti-coagulant therapy.

Embodiment II-71. The method of any of embodiments II-1 to II-70, wherein the subject has a hemophilia; and the hemophilia is selected from among hemophilia A, hemophilia B and hemophilia C, hemophilia A with inhibitors, and hemophilia B with inhibitors.

Embodiment II-72. The method of embodiment II-7 1, wherein the hemophilia is congenital.

Embodiment II-73. The method of embodiment II-71, wherein the hemophilia is acquired.

Embodiment II-74. The method of any of embodiments II-7 1 to II-73, wherein the subject has autoantibodies to factor VIII or factor IX.

Embodiment II-75. The method of any of embodiments II-7 1 to II-74, wherein a single subcutaneous dose of the modified FVIIa is about 60 µg/kg to about 120 µg/kg, based on the weight of the treated subject.

Embodiment II-76. The method of any of embodiments II-7 1 to II-75, wherein a single subcutaneous dose of the modified FVIIa is about 60 µg/kg, based on the weight of the treated subject.

Embodiment II-77. The method of any of embodiments II-7 1 to II-75, wherein a single subcutaneous dose of the modified FVIIa is about 120 µg/kg, based on the weight of the treated subject.

Embodiment II-78. The method of embodiment II-70, wherein the subject has Factor VII deficiency.

Embodiment II-79. The method of embodiment II-78, wherein a single subcutaneous dose of the modified FVIIa is about 10 to about 20 µg/kg, based on the weight of the treated subject.

Embodiment II-80. The method of any of embodiments II-78 to II-79, wherein a single subcutaneous dose of the modified FVIIa is about 10 µg/kg, based on the weight of the treated subject.

Embodiment II-81. The method of any of embodiments II-78 to II-79, wherein a single subcutaneous dose of the modified FVIIa is about 20 µg/kg, based on the weight of the treated subject.

Embodiment II-82. The method of any of embodiments II-1 to II-81, wherein the subject has been receiving oral anticoagulant therapy.

Embodiment II-83. The method of embodiment II-82, wherein the oral anticoagulant therapy comprises one or more of heparin, dabigatran, rivaroxaban, apixaban, bemiparin, nadroparin, reviparin, enoxaparin, parnaparin, certoparin, dalteparin, and tinzaparin.

Embodiment II-84. The method of any of embodiments II-1 to II-83, wherein the modified FVIIa has a potency greater than the FVIIa of SEQ ID NO: 3.

Embodiment II-85. The method of any of embodiments II-1 to II-84, wherein the modified FVIIa has increased coagulant activity, compared to wild-type FVIIa of SEQ ID NO: 3, in the absence of tissue factor.

Embodiment II-86. The method of any of embodiments II-1 to II-84, wherein the modified FVIIa has increased coagulant activity in the presence of tissue factor.

Embodiment II-87. The method of any of embodiments II-1 to II-86, wherein the modified FVIIa has kcat/km in a tissue-factor dependent assay that is greater than 100%, 150%, 200%, or 250% or more than unmodified FVIIa (SEQ ID NO: 3) in the same assay.

Embodiment II-88. The method of any of embodiments II-1 to II-87, wherein the modified FVIIa has coagulation activity that is at least 1.5 times the activity of unmodified FVIIa of SEQ ID NO: 3 in the same assay.

Embodiment II-9. The method of any of embodiments II-1 to II-88, wherein the modified FVIIa has potency at least 3, or 4, or 5 times that of the unmodified FVIIa of SEQ ID NO: 3.

Embodiment II-90. The method of any of embodiments II-1 to II-89, wherein the FVIIa has increased potency as assessed by activated partial thromboplastin time (aPTT) and/or thromboelastography (TEG) or any assay that assesses thrombin generation.

Embodiment II-91. The method of any of embodiments II-1 to II-90, wherein coagulation activity of the modified FVIIa polypeptide is at least 110%, 150%, 200%, 250%, 300%, 400%, 500% or more of the coagulation activity of the unmodified FVIIa polypeptide of SEQ ID NO: 3.

Embodiment II-92. The method of any of embodiments II-1 to II-91, wherein the modified FVIIa has increased serum half-life or an increased terminal elimination half-life compared to the unmodified FVIIa.

Embodiment II-93. The method of any of embodiments II-1 to II-92, wherein the modified FVIIa has greater coagulation activity or potency than the unmodified FVIIa that has the primary amino acid sequence set forth in SEQ ID NO: 3.

Embodiment II-94. The method of any of embodiments II-1 to II-93, wherein: the modified FVIIa polypeptide, when in an activated form, exhibits procoagulant activity.

Embodiment II-95. The method of embodiment II-94, wherein:

the procoagulant activity is greater than procoagulant activity of a FVIIa polypeptide having the primary amino acid sequence set forth in SEQ ID NO: 3.

Embodiment II-96. The method of any of embodiments II-1 to II-95, wherein the modified FVIIa polypeptide is two-chain activated Factor VII (FVIIa) polypeptide comprising the amino acid sequence of SEQ ID NO: 280 or comprising the amino acid sequence of SEQ ID NO: 138 cleaved between the arginine at position 152 and the isoleucine at position 153.

Embodiment II-97. The method of embodiment II-96, wherein the first and second chains are linked by a least one disulfide bridge.

Embodiment II-98. The method of any of embodiments II-1 to II-97, wherein the modified FVIIa polypeptide has at least 90% amino acid sequence identity to SEQ ID NO: 280, wherein the amino acids corresponding to positions 128, 129, 286 and 298 of SEQ ID NO: 280 are invariant.

Embodiment II-99. The method of any of embodiments II-1 to II-97, wherein the first and second chains of the two-chain polypeptide consist respectively of amino acids 1-152 and 153-406 of SEQ ID NO: 280.

Embodiment II-100. The method of any of embodiments II-1 to II-99, wherein the modified FVIIa polypeptide comprises one or more amino acid modification(s) that increases resistance to antithrombin-III, increases binding and/or affinity to phospholipids, increases affinity for tissue factor, increases intrinsic activity, increases TF-dependent activity, increases coagulant activity, alters the conformation of the polypeptide to alter zymogenicity, increases catalytic or coagulant activity by shifting the equilibrium between highly active and less active FVIIa conformations in favor of the highly active conformations, increases resistance to proteases, decreases glycosylation, increases glycosylation, reduces immunogenicity, increases stability, and/or facilitates chemical group linkage.

Embodiment II-101. The method of any of embodiments II-1 to II-100, wherein the primary sequence of the unmodified FVIIa polypeptide consists of the sequence of amino acids set forth in SEQ ID NO: 3.

Embodiment II-102. The method of any of embodiments II-1 to II-101, wherein the modified FVIIa polypeptide is post-translationally modified.

Embodiment II-103. The method of embodiment II-102, wherein the post-translational modification comprises glycosylation.

Embodiment II-104. The method of embodiment II-103, wherein a post-translational modification is O-linked glycosylation.

Embodiment II-105. The method of embodiment II-103 or embodiment II-104, wherein a post-translational modification is N-linked glycosylation.

Embodiment II-106. The method of any of embodiments II-102 to II-105, wherein a post-translational modification is carboxylation of glutamic acid to γ-carboxyglutamic acid.

Embodiment II-107. The method of any of embodiments II-102 to II-106, wherein a post-translational modification is hydroxylation of aspartic acid to β-hydroxyaspartic acid Embodiment II-108. The method of any of embodiments II-1 to II-107, wherein the modification(s) of the FVIIa polypeptide is/are an amino acid replacement, insertion, deletion, or combinations thereof.

Embodiment II-109. The method of any of embodiments II-1 to II-108, wherein the subcutaneous administration of the modified FVIIa has increased terminal elimination half-life compared to an intravenous administration of the modified FVIIa.

Embodiment II-110. The method of any of embodiments II-1 to II-109, wherein a dose of the modified FVIIa is administered in a multiple dosing regimen.

Embodiment II-111. The method of embodiment II-110, wherein the multiple dosing regimen comprises at least two or at least three doses within about 24 hours.

Embodiment II-112. The method of any of embodiments II-110 to II-111, wherein at least one dose of the multiple dosing regimen comprises about 30 μg/kg, about 45 μg/kg, about 60 μg/kg, about 90 μg/kg, or about 120 μg/kg of body weight of the subject.

Embodiment II-113. The method of any of embodiments II-110 to II-112, wherein each dose of the multiple dosing regimen is identical.

Embodiment II-114. The method of any of embodiments II-110 to II-112, wherein each dose of the multiple dosing regimen occurs about 2 to about 6 hours apart for a predetermined time period.

Embodiment II-115. The method of embodiment II-114, wherein the predetermined time period is about 24 hours.

Embodiment II-116. The method of any of embodiments II-110 to II-115, wherein the multiple dosing regimen comprises a maximum of 3 doses within about 24 hours.

Embodiment II-117. The method of any of embodiments II-110 to II-116, wherein each dose of the multiple dosing regimen is 60 μg/kg based on the weight of the treated subject.

Embodiment II-118. The method of any of embodiments II-110 to II-117, wherein the multiple dosing regimen is administered as an ascending dosing regimen.

Embodiment II-119. The method of any of embodiments II-1 to II-118, wherein at least one dose of the modified FVIIa is administered intravenously prior the subcutaneous administration.

Embodiment II-120. The method of any of embodiments II-1 to II-119, wherein any single dose of the modified FVIIa is administered as a split dose at two different anatomical sites of the subject.

Embodiment II-121. The method of any of embodiments II-1 to II-119, wherein any single dose of the modified FVIIa is administered as a split dose at a single anatomical site of the subject.

Embodiment II-122. The method of any of embodiments II-1 to II-121, wherein any single dose of the modified FVIIa is about 2 to about 6 mg in amount.

Embodiment II-123. The method of any of embodiments II-1 to II-122, wherein any single dose of the modified FVIIa is about 1, about 1.5, about 2, about 2.5, about 3, about 3.5, about 4, about 4.5, about 5, about 5.5, about 6, or about 6.5 mg in amount.

Embodiment II-124. The method of any of embodiments II-1 to II-123, wherein any single dose of the modified FVIIa is about 4.5 mg in amount.

Embodiment II-125. The method of any of embodiments II-1 to II-124, wherein the subject is an adult.

Embodiment II-126. The method of any of embodiments II-1 to II-124, wherein the subject is an adolescent, a child, or an infant.

Embodiment II-127. The method of any of embodiments II-1 to II-126, wherein the modified FVIIa is administered as a monotherapy.

Embodiment II-128. The method of any of embodiments II-1 to II-127, wherein the subcutaneous administration of the modified FVIIa has an activity or potency greater than an intravenous administration of the modified FVIIa polypeptide.

Embodiment II-129. The method of any of embodiments II-1 to II-128, wherein the subcutaneous administration of the modified FVIIa has an activity or potency greater than an intravenous administration of an FVIIa polypeptide that is unmodified.

Embodiment II-130. The method of any of embodiments II-1 to II-129 wherein the subcutaneous administration of the modified FVIIa has an activity or potency greater than a subcutaneous administration of an FVIIa polypeptide that is unmodified.

Embodiment II-131. The method of any of embodiments II-1 to II-130, wherein the activity or potency is bioavailability and/or pharmacokinetic profiles of the modified FVIIa.

Embodiment II-132. The method of any of embodiments II-1 to II-131, wherein the modified FVIIa comprises the amino acid sequence set forth in SEQ ID NO: 280 or SEQ ID NO: 138.

Embodiment II-133. A method of providing an on-demand treatment to a subject experiencing a bleed or to a subject likely to experience a bleed, comprising administering to the subject a subcutaneous dose of a modified FVIIa comprising modifications at least at a position corresponding to position 286 and at a position corresponding to position 298 in a FVII polypeptide comprising the sequence of amino acids set forth in SEQ ID NO: 3 or in a corresponding residue in a FVII polypeptide, wherein:
the modification at position 286 is an amino acid replacement with Arg (R);
the modification at position 298 is an amino acid replacement with Gln (Q); and
the dose is about 10 to about 120 μg/kg of body weight of the subject.

Embodiment II-134. The method of embodiment II-133, the modified FVIIa further comprising a modification at a position corresponding to position 128 in the FVII polypeptide having
the sequence of amino acids set forth in SEQ ID NO: 3, wherein
the modification at position 128 is an amino acid replacement with Asn (N).

Embodiment II-135. The method of any of embodiments II-133 to II-134, the modified FVIIa further comprising a modification at a position corresponding to position 129 in the FVII polypeptide having the sequence of amino acids set forth in SEQ ID NO: 3, wherein:

the modification at position 129 is Ala (A).

Embodiment II-136. The method of any of embodiments II-133 to II-135, wherein the subcutaneous dose of a modified FVIIa is administered in a multiple dosing regimen.

Embodiment II-137.The method of embodiment II-136, wherein the multiple dosing regimen comprises at least two or at least three doses within a 24 hour period.

Embodiment II-138. The method of any of embodiments II-136 to II-137, wherein each dose of the multiple dosing regimen is identical.

Embodiment II-139. The method of any of embodiments II-136 to II-138, wherein the multiple dosing regimen comprises two doses within a 24 hour period.

Embodiment II-140. The method of any of embodiments II-136 to II-138, wherein the multiple dosing regimen comprises three doses within a 24 hour period.

Embodiment II-141. The method of any of embodiments II-136 to II-140, wherein each dose of the multiple dosing regimen occurs about 2 to about 6 hours apart for a predetermined time period.

Embodiment II-142. The method of embodiment II-141, wherein each dose of the multiple dosing regimen occurs about 3 hours apart for a predetermined time period.

Embodiment II-143. The method of any of embodiments II-141 to II-142, wherein the predetermined time period is about 24 hours.

Embodiment II-144.The method of any of embodiments II-133 to II-143, wherein the subject has hemophilia A, hemophilia B, hemophilia A with inhibitors, hemophilia B with inhibitors, Factor VII deficiency, Glanzmann thrombasthenia, acquired hemophilia, or is taking anti-coagulant therapy.

Embodiment II-145.The method of embodiment II-144, wherein the subject has a hemophilia; and the hemophilia is selected from among hemophilia A, hemophilia B and hemophilia C, hemophilia A with inhibitors, and hemophilia B with inhibitors.

Embodiment II-146.The method of embodiment II-145, wherein the hemophilia is congenital.

Embodiment II-147. The method of embodiment II-145, wherein the hemophilia is acquired.

Embodiment II-148.The method of any of embodiments II-133 to II-147, wherein the subject has been receiving oral anticoagulant therapy.

Embodiment II-149.The method of embodiment II-148, wherein the oral anticoagulant therapy comprises one or more of heparin, dabigatran, rivaroxaban, apixaban, bemiparin, nadroparin, reviparin, enoxaparin, parnaparin, certoparin, dalteparin, and tinzaparin.

Embodiment II-150. The method of any of embodiments II-133 to II-149, wherein the dose is about 20 to about 60 μg/kg of body weight of the subject.

Embodiment II-151. The method of any of embodiments II-133 to II-150, wherein the dose is about 60 μg/kg of body weight of the subject.

Embodiment II-152. The method of any of embodiments II-133 to II-151, wherein the on-demand treatment comprises administering the treatment to a subject experiencing a bleed.

Embodiment II-153. The method of embodiment II-152, wherein the subcutaneous dose is administered about 1 minute to about 1 hour, or about 2, or about 3, or about 4 hours after onset of the bleed.

Embodiment II-154. The method of any of embodiments II-152 to II-153, wherein the subcutaneous dose is administered about 1 minute after onset of the bleed.

Embodiment II-155. The method of any of embodiments II-152 to II-153, wherein the subcutaneous dose is administered about 1 hour after onset of the bleed.

Embodiment II-156. The method of any of embodiments II-133 to II-155, wherein the on-demand treatment comprises administering the treatment to a subject likely to experience a bleed.

Embodiment II-157. The method of embodiment II-156, wherein the subcutaneous dose is administered about 1 minute to about 1 hour, or about 2, or about 3, or about 4, or about 5, or about 6, or about 7 hours before the likelihood of a bleed.

Embodiment II-158. The method of any of embodiments II-156 to II-157, wherein the subcutaneous dose is administered about 1 minute before the likelihood of a bleed.

Embodiment II-159. The method of any of embodiments II-156 to II-157, wherein the subcutaneous dose is administered about 1 hour before the likelihood of a bleed.

Embodiment II-160. The method of any of embodiments II-133 to II-159, wherein the subcutaneous dose is administered with the use of a device.

Embodiment II-161. The method of embodiment II-160, wherein the device is an injector pen.

Embodiment II-162. The method of any of embodiments II-133 to II-161, wherein the subcutaneous administration of the modified FVIIa has increased activity or potency.

Embodiment II-163. The method of embodiment II-162, wherein the subcutaneous administration of the modified FVIIa has an activity or potency greater than an intravenous administration of the modified FVIIa polypeptide.

Embodiment II-164. The method of any of embodiments II-162 to II-163, wherein the subcutaneous administration of the modified FVIIa has an activity or potency greater than an intravenous administration of an FVIIa polypeptide that is unmodified.

Embodiment II-165. The method of any of embodiments II-162 to II-164, wherein the subcutaneous administration of the modified FVIIa has an activity or potency greater than a subcutaneous administration of an FVIIa polypeptide that is unmodified.

Embodiment II-166. The method of any of embodiments II-162 to II-165, wherein the activity or potency is bioavailability and/or pharmacokinetic profiles of the modified FVIIa.

Embodiment II-167. The method of any of embodiments II-162 to II-166, wherein the modified FVIIa polypeptide is two-chain activated Factor VII (FVIIa) polypeptide comprising the amino acid sequence of SEQ ID NO: 280 cleaved between the arginine at position 152 and the isoleucine at position 153.

Embodiment II-168.A pharmaceutical composition for a single dosage subcutaneous administration, comprising a single therapeutically effective dose of a modified FVIIa in a pharmaceutically acceptable carrier for subcutaneous administration for an on-demand treatment of a bleed; wherein the modified FVIIa comprises modifications at least at a position corresponding to position 286 and at a position corresponding to position 298 in a FVII polypeptide comprising the sequence of amino acids set forth in SEQ ID NO: 3 or in a corresponding residue in a FVII polypeptide, wherein:

the modification at position 286 is an amino acid replacement with Arg (R);

the modification at position 298 is an amino acid replacement with Gln (Q); and the modified FVIIa has increased activity or potency.

Embodiment II-169. The pharmaceutical composition of embodiment II-168, wherein the modified FVIIa has an activity or potency greater than an intravenous administration of the modified FVIIa polypeptide.

Embodiment II-170. The method of any one of embodiments II-168 to II-169, wherein the modified FVIIa has an activity or potency greater than an intravenous administration of an FVIIa polypeptide that is unmodified.

Embodiment II-171. The method of any one of embodiments II-168 to II-170, wherein the modified FVIIa has an activity or potency greater than a subcutaneous administration of an FVIIa polypeptide that is unmodified.

Embodiment II-172. The pharmaceutical composition of any one of embodiments II-168 to II-171, the modified FVIIa further comprising modifications at a position corresponding to position 128 in the FVII polypeptide having the sequence of amino acids set forth in SEQ ID NO: 3, wherein:

the modification at position 128 is an amino acid replacement with Asn (N).

Embodiment II-173. The pharmaceutical composition of any one of embodiments II-168 to II-172, the modified FVIIa further comprising modifications at a position corresponding to position 128 and at a position corresponding to position 129 in the FVII polypeptide having the sequence of amino acids set forth in SEQ ID NO: 3, wherein:

the modification at position 128 is an amino acid replacement with Asn (N); and the modification at position 129 is Ala (A).

Embodiment II-174. The pharmaceutical composition of any of embodiments II-168 to II-173, wherein the amount of modified FVIIa is from 100 µg to 35 mg in a volume of 1 ml to 10 ml.

Embodiment II-175. The pharmaceutical composition of any of embodiments II-168 to II-174, wherein the amount of modified FVIIa is from 500 µg to 25 mg in a volume of 1 ml to 10 ml.

Embodiment II-176. The pharmaceutical composition of any of embodiments II-168 to II-175, wherein the amount of modified FVIIa is from 50 µg to 40 mg in a volume of 0.1 ml to 10 ml.

Embodiment II-177. The pharmaceutical composition of any of embodiments II-168 to II-176, wherein the amount of modified FVIIa is from 1 mg to 10, 15, 20 or 25 mg in a volume of 0.5 ml to 10 ml.

Embodiment II-178. The pharmaceutical composition of any of embodiments II-168 to II-177 that is in a volume of 1 ml to 5 ml, or 1 ml to 3 ml, or 1 ml to 1.5 ml.

Embodiment II-179. A container, comprising the pharmaceutical composition of any of embodiments II-168 to II-178.

Embodiment II-180. The container of embodiment II-179, wherein the container is a syringe or injector pen.

Embodiment II-181. The container of embodiment II-179 or embodiment II-180, wherein the pharmaceutical composition is lyophilized.

Embodiment II-182. The container of any of embodiments II-179 to II-181 that comprises two chambers, wherein one chamber contains the lyophilized composition; and another chamber comprises vehicle for dissolving the lyophilized composition.

Embodiment II-183. An on-demand method of treating a bleed in a subject, comprising subcutaneously administering to the subject the pharmaceutical composition of any of embodiments II-167 to II-178.

Embodiment II-184. The method of embodiment II-183, wherein the composition is administered within 1, 2, or 3 hours or within 15, 45, 60, 75, or 90 minutes before or after the bleed.

Embodiment III-1. A modified Factor VIIa for use in a method of treating a bleeding event in a subject, wherein:

the modified Factor VIIa comprises modifications at least at a position corresponding to position 286 and at a position corresponding to position 298 in a FVII polypeptide comprising the sequence of amino acids set forth in SEQ ID NO: 3 or in a corresponding residue in a FVII polypeptide, wherein:

the modification at position 286 is an amino acid replacement with Arg (R);

the modification at position 298 is an amino acid replacement with Gln (Q); and wherein:

the method comprises the subcutaneous administration of a dose of the modified FVIIa to a subject.

Embodiment 111-2. The modified Factor VIIa for use according to embodiment IIII-1, wherein the modified FVIIa has:

(a) a coagulation activity or potency when subcutaneously administered that is greater than the coagulation activity or potency of the modified FVIIa polypeptide when intravenously administered; and/or (b) a coagulation activity or potency when subcutaneously administered that is greater than the coagulation activity or potency of an unmodified FVIIa polypeptide when intravenously administered; optionally wherein the unmodified FVIIa has the primary amino acid sequence set forth in SEQ ID NO: 3; and/or (c) a coagulation activity or potency when subcutaneously administered that is greater than the coagulation activity or potency of an unmodified FVIIa polypeptide when subcutaneously administered; optionally wherein the unmodified FVIIa has the primary amino acid sequence set forth in SEQ ID NO: 3.

Embodiment III-3. The modified Factor VIIa for use according to embodiment IIII-1 or embodiment III-2, wherein the modified FVIIa further comprises a modification at a position corresponding to position 128 in the FVII polypeptide having the sequence of amino acids set forth in SEQ ID NO: 3, wherein:

the modification at position 128 is an amino acid replacement with Asn (N).

Embodiment III-4. The modified Factor VIIa for use according to any one of embodiments III-1 to III-3, the modified FVIIa further comprising a modification at a position corresponding to position 129 and in the FVII polypeptide having the sequence of amino acids set forth in SEQ ID NO: 3, wherein:

the modification at position 129 is an amino acid replacement with Ala (A).

Embodiment III-5. The modified Factor VIIa for use according to any one of embodiments III-1 to III-4, wherein the dose is administered subcutaneously within about 7 or 6 or 5 or 4 or 3 or 2 or 1 or fewer hours or minutes before and/or after the bleeding event.

Embodiment III-6. The modified Factor VIIa for use according to any one of embodiments III-1 to III-5, wherein the dose is about 10 to about 120 µg/kg of body weight of the subject.

Embodiment III-7. The modified Factor VIIa for use according to any one of embodiments III-1 to III-6, whereby the amount of bleeding is reduced or stopped or the cause of the bleed is corrected or is healed.

Embodiment III-8. The modified Factor VIIa for use according to any one of embodiments III-1 to III-7, wherein the method provides an on-demand treatment to a subject experiencing a bleed or to a subject likely to experience a bleed.

Embodiment III-9. A modified Factor VIIa for use in a method of treating a bleeding event in a subject, wherein the modified Factor VIIa comprises modifications at least at a position corresponding to position 128, at a position corresponding to position 129, at a position corresponding to position 286, and at a position corresponding to position 298 in a FVII polypeptide comprising the sequence of amino acids set forth in SEQ ID NO: 3 or in a corresponding residue in a FVII polypeptide, wherein:

the modification at position 128 is an amino acid replacement with Asn (N);

the modification at position 129 is an amino acid replacement with Ala (A);

the modification at position 286 is an amino acid replacement with Arg (R); and the modification at position 298 is an amino acid replacement with Gln (Q); and wherein:

the method comprises the subcutaneous administration of a dose of the modified FVIIa to a subject; wherein the dose is administered subcutaneously within about 7 or 6 or 5 or 4 or 3 or 2 or 1 or fewer hours or minutes before and/or after the bleeding event; and wherein the dose is about 10 to about 120 μg/kg of body weight of the subject.

Embodiment III-10. The modified Factor VIIa for use according to embodiment III-9, wherein the modified FVIIa has:

(a) a coagulation activity or potency when subcutaneously administered that is greater than the coagulation activity or potency of the modified FVIIa polypeptide when intravenously administered; or (b) a coagulation activity or potency when subcutaneously administered that is greater than the coagulation activity or potency of an unmodified FVIIa polypeptide when intravenously administered; optionally wherein the unmodified FVIIa has the primary amino acid sequence set forth in SEQ ID NO: 3; or (c) a coagulation activity or potency when subcutaneously administered that is greater than the coagulation activity or potency of an unmodified FVIIa polypeptide when subcutaneously administered; optionally wherein the unmodified FVIIa has the primary amino acid sequence set forth in SEQ ID NO: 3.

Embodiment III-11. The modified Factor VIIa for use according to any one of embodiments III-1 to III-10, wherein the modified Factor VIIa comprises the amino acid sequence as set forth in SEQ ID NO: 280 or SEQ ID NO: 138.

EXAMPLES

The following examples are included for illustrative purposes only and are not intended to limit the scope of the invention.

As used in the subsequent examples, the T128N/P129A/Q286R/M298Q FVIIa polypeptide comprises the amino acid sequence as set forth in SEQ ID NO: 280, and the Q286R/M298Q FVIIa polypeptide comprises the amino acid sequence as set forth in SEQ ID NO: 138.

Example 1

In Vivo Assessment of Variant FVIIa Procoagulant Activity in Mice with Congenital Hemophilia A and Pre-Treated with Subcutaneous Administration of Variant FVIIa Cloning, Expression, Purification, and Activation of FVIIa Polypeptides Methods of cloning, expression, purification, and activation of the FVIIa polypeptides, and calculation of the pharmacokinetics of the FVIIa polypeptides are carried out as described in PCT Publication No. WO2009126307A2, published on Oct. 15, 2009, which is incorporated by reference in its entirety.

This example demonstrates the procoagulant effect of dosing modified FVIIa subcutaneously at time points before and after injury using a tail clip bleeding model in hemophilia A mice. A mouse model of hemophilia A ("Haem A," B6; 129S4-F8$^{tm1Kaz}$/J; Bi et al. (1995) Nat Gen 10(1):119-21) was used to assess the procoagulant activity of variant FVIIa polypeptides. These FVIII deficient mice recapitulate key features of hemophilia A. Homozygous females and hemizygous males express less than 1% of normal Factor VIII activity and exhibit prolonged clotting times. Hemophilia A mice were pre-dosed at various time points with the modified FVIIa containing the replacements T128N/P129A/Q286R/M298Q (see SEQ ID NO: 280) produced as described in Example 1. Surgical removal of the tips of the tails was performed to initiate bleeding. The amount of blood lost was measured to assess the procoagulant activity of the modified FVIIa containing T128N/P129A/Q286R/M298Q in this model.

The mice were subcutaneously administered 1.5 mg/kg the modified FVIIa polypeptide (T128N/P129A/Q286R/M298Q), at 15, 30, 60, or 90 minutes before tail injury (3 mice per group). Prior to initiating bleeding, each mouse was anaesthetized by intraperitoneal administration of a 100 mg/kg ketamine and 10 mg/kg xylazine. As a positive control, 3 mice were intravenously administered 1.5 mg/kg of the modified FVIIa at 5 minutes before tail injury. As a negative control, 3 mice were subcutaneously administered vehicle at 90 minutes before tail injury.

At the requisite amount of time following the modified FVIIa administration, the tails were severed 2 mm from the tip using a sharp razor blade, to initiate bleeding. The tails were then immersed in 15 mL tubes with the collection tube replaced at 4-minute intervals. At the end of the experiment the mice were euthanized by a Schedule 1 approved method.

To determine the amount of blood lost during the bleeding, the contents of the tubes containing the saline and blood were assayed for hemoglobin content. Haemoglobin content was measured using a QuantiChrom™ Haemoglobin assay kit, which has been validated for rodents (Product code DIHB-250, Universal Biologicals (Cambridge) Ltd). Triton X-100 was diluted 1 to 4 in sterile water and 100 μL was added to 1 mL of the samples to cause hemolysis. The absorbance of the samples was then measured at a wavelength of 546 nm. To calculate the amount of blood lost, the absorbance was read against a standard curve generated by measuring the absorbance at 546 nm of known volumes of murine blood, diluted in saline and hemolysed as above with Triton X-100.

The results of blood loss following administration of a 1.5 mg/kg dose of the modified FVIIa are shown below in Table 1. The tubes were visually inspected, and the relative amount of blood was in accord with the findings in the Table. The blood loss in the vehicle group (buffer, n=3) was 652±110 μL over the 20 minute period. The blood loss in the positive control (intravenously administered, 1.5 mg/kg modified FVIIa; n=3) was 171±76 μL over the 20 minute period, which was similar to blood loss in mice administered the modified FVIIa subcutaneously 15 minutes prior to injury.

TABLE 1

Pretreatment With The Modified FVIIa Containing T128N/P129A/Q286R/M298Q Decreases Blood Loss

| Condition | Minutes administered before injury | Route | Average Total Blood Loss (μL) |
|---|---|---|---|
| Vehicle | 90 | Subcutaneous | 652 ± 110 |
| 1.5 mg/kg modified FVIIa | 5 | Intravenous | 171 ± 76 |
| 1.5 mg/kg modified FVIIa | 15 | Subcutaneous | 240 ± 54 |
| 1.5 mg/kg modified FVIIa | 30 | Subcutaneous | 374.0 ± 81.5 |
| 1.5 mg/kg modified FVIIa | 60 | Subcutaneous | 406 ± 20 |
| 1.5 mg/kg modified FVIIa | 90 | Subcutaneous | 492 ± 55 |

Therefore, the modified FVIIa that are more potent than wild type, can be subcutaneously administered on-demand to prevent or lessen bleeding before an expected bleed or after a bleed has started to lessen or stop it (see also Examples 2 and 3 below).

Example 2

Dose Response Study Assessing Modified FVIIa Procoagulant Activity in Mice with Congenital Hemophilia A and Pretreated with Variant FVIIa 15 Minutes Prior to Injury FIG. 4A is a diagram illustrating the study design for an acute injury model with subcutaneous dosing before injury in hemophilia A mice. A dose response study in which 0.15, 0.45, 1.5, 3 or 4.5 mg/kg of the modified FVIIa containing T128N/P129A/Q286R/M298Q (SEQ ID NO: 280), or vehicle, was subcutaneously administered 15 minutes prior to tail injury, was conducted. Tail injury, blood collection and hemoglobin content assessment were performed as detailed above. Three mice were assessed for each condition.

As depicted in FIG. 4A, positive control, negative control, and a test group were used in the acute injury study. For a positive control, a group of mice were intravenously administered 1.5 mg/kg of the modified FVIIa containing T128N/P129A/Q286R/M298Q (see, SEQ ID NO: 280) 5 minutes prior to injury. For the negative control, a group of mice were subcutaneously administered vehicle 15 minutes prior to injury. For the test group, 0.15, 0.45, 1.5, 3 or 4.5 mg/kg of the modified FVIIa was subcutaneously administered 15 minutes prior to tail injury.

Mice that received the vehicle on average lost 684 μL blood in the 20 minute assay. This was reduced in mice administered the modified FVIIa. The total amount of blood loss was reduced in a dose dependent manner in mice treated with increasing concentrations of the modified FVIIa administered subcutaneously 15 minutes prior to injury ($ED_{50}$=387 μg/kg; see Table 2, below). For example, subcutaneous administration of 3.0 mg/kg of the modified FVIIa resulted in blood loss of 149 μL, which was similar in amount to the blood loss following intravenous administration 5 minutes prior to injury (168 μL).

FIG. 5 is a graph depicting the results of the study using subcutaneous administration of the modified FVIIa 15 minutes before injury. The results are also summarized in Table 2 below. FIG. 5 depicts a non-linear graph, wherein the non-linear curve fit was constrained with a no-effect level equal to the mean of the saline-treated group, and with a max effect level at the level of normal historic controls, obtained from B6; 129S mice serving as normal control data. The two control groups not labeled with a dose are also included in the graph. These controls are as follows: the negative control was subcutaneous administration of saline, and the positive control is the intravenous administration of the T128N/P129A/Q286R/M298Q FVIIa at a dose of 1.5 mg/kg.

TABLE 2

Subcutaneous administration of modified FVIIa containing T128N/P129A/Q286R/M298Q prior to injury decreases blood loss in a dose dependent manner

| Condition | Minutes administered before injury | Route | Average Total Blood Loss (μL) |
|---|---|---|---|
| Vehicle | 15 | Subcutaneous | 684 ± 58 |
| 1.5 mg/kg modified FVIIa | 5 | Intravenous | 168 ± 44 |
| 0.15 mg/kg modified FVIIa | 15 | Subcutaneous | 526 ± 29 |
| 0.45 mg/kg modified FVIIa | 15 | Subcutaneous | 438 ± 50 |
| 1.5 mg/kg modified FVIIa | 15 | Subcutaneous | 254 ± 77 |
| 3.0 mg/kg modified FVIIa | 15 | Subcutaneous | 149 ± 26 |

Example 3

Dose Response Study Assessing Variant FVIIa Procoagulant Activity Administered Following Injury to Mice with Congenital Hemophilia A FIG. 4B is a diagram illustrating the study design for an acute injury model with subcutaneous dosing after injury (on-demand) in hemophilia A mice. A dose response study in which 1.5 or 4.5 mg/kg of the modified FVIIa containing T128N/P129A/Q286R/M298Q (SEQ ID NO: 280), or vehicle, was subcutaneously administered one minute after tail injury was conducted. Tail injury, blood collection and hemoglobin content assessment were performed as detailed above. Bleeding was initiated via tail injury with a sharp razor blade 2 mm from the end of the tail, and the tail was placed in warm saline for blood collection. One minute following injury, the modified FVIIa or vehicle was administered subcutaneously. Bleeding was assessed every 4 minutes for an additional 19 minutes, for a total bleed time of 20 minutes. Three mice were assessed for each condition.

Figure 6:
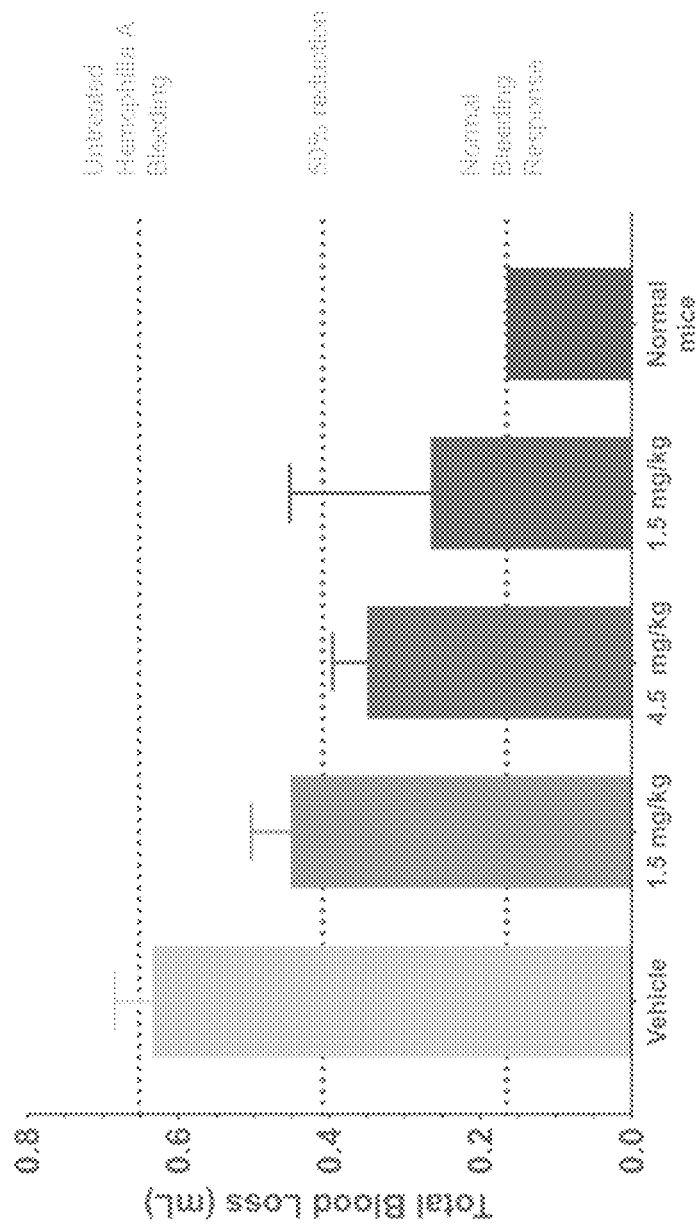
FIG. 6 is a graph showing the results of the on-demand effect of a modified FVIIa administered subcutaneously

Mice that received vehicle 1 minute after injury lost 635±50 μL blood in the 20 minute assay. This was reduced in mice that were subcutaneously administered modified FVIIa one minute after injury. Average blood loss was 452±52 μL and 350±46 μL for 1.5 mg/kg and 4.5 mg/kg subcutaneously administered modified FVIIa, respectively. Thus, the total amount of blood loss decreased in a dose dependent manner in mice treated with increasing concentrations of the modified FVIIa via the subcutaneous route immediately after injury. The highest dose (4.5 mg/kg) administered subcutaneously after injury decreased bleeding significantly compared to vehicle (p=0.002). These results are depicted in FIG. 6 and are also summarized in Table 3 below. FIG. 6 is a graph showing the results of the on-demand effect of the T128N/P129A/Q286R/M298Q FVIIa administered subcutaneously as compared to NovoSeven® administered intravenously, both administered one minute after bleeding has started. Each group contained 3 mice. The vehicle shows the total blood loss in mL in untreated Hemophilia A bleeding, while the normal mice show a normal bleeding response. These results showed that the T128N/P129A/Q286R/M298Q FVIIa was efficacious when administered subcutaneously, both after and before injury, and that the T128N/P129A/Q286R/M298Q FVIIa could be used on-demand to treat acute bleeding. These data also provide a basis for treatment of a bleed with subcutaneous administration in hemophilia as well as in FVII deficiency.

TABLE 3

Decreased blood loss after injury and subsequent subcutaneous administration of the modified FVIIa containing T128N/P129A/Q286R/M298Q

| Condition | Minutes administered after injury | Route | Average Total Blood Loss (µL) |
|---|---|---|---|
| Vehicle | 1 | Subcutaneous | 635 ± 50 |
| 1.5 mg/kg modified FVIIa | 1 | Subcutaneous | 452 ± 52 |
| 4.5 mg/kg modified FVIIa | 1 | Subcutaneous | 350 ± 46 |

Figure 7:
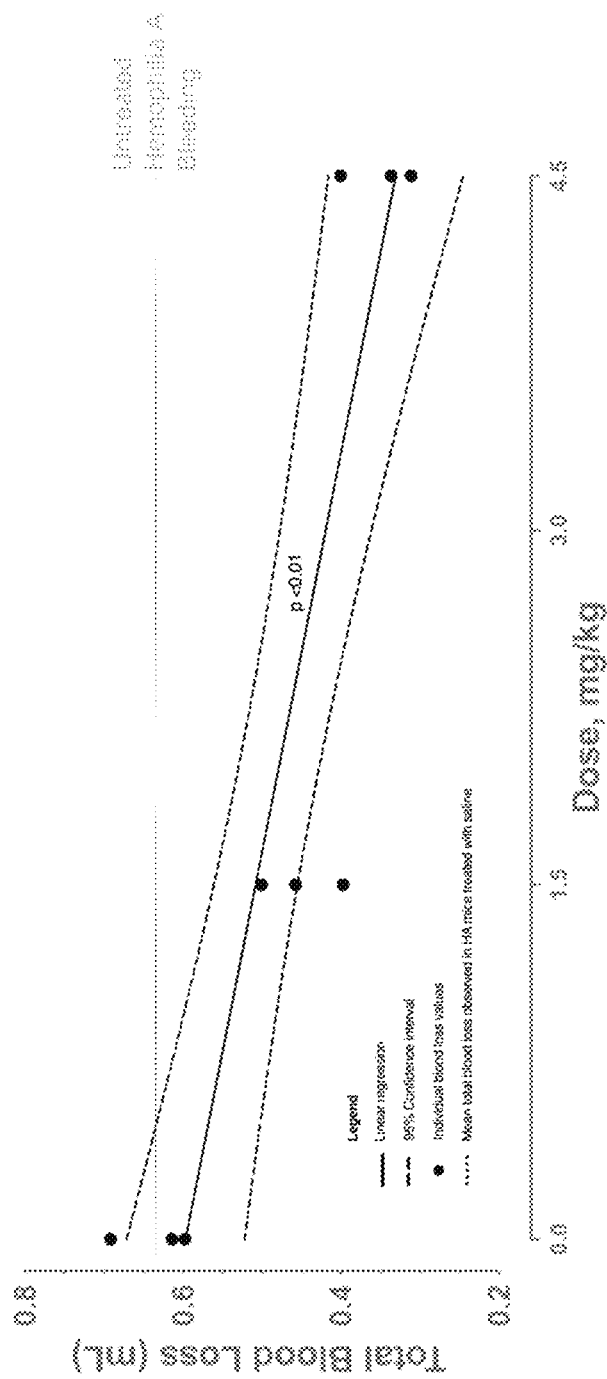
FIG. 7 is a graph depicting the dose response of a modified FVIIa administered subcutaneously one minute after injury

The results of the dose response study using are depicted in FIG. 7; FIG. 7 is a graph depicting the dose response of T128N/P129A/Q286R/M298Q FVIIa administered subcutaneously one minute after injury. The solid dots represent blood loss for individual mice that were tested. The solid line represents the calculated linear regression. The dashed line represents the 95% confidence interval (CI) for the linear regression.

Table 4 summarizes the result of decreased blood loss observed at various time points following injury and with subsequent subcutaneous administration of the T128N/P129A/Q286R/M298Q FVIIa.

TABLE 4

Decreased blood loss at various time points following injury and subsequent subcutaneous administration of modified FVIIa

| Condition | Minutes after injury | Average Blood Loss (µL) |
|---|---|---|
| Vehicle | 4 | 127.5 |
| Vehicle | 8 | 75 |
| Vehicle | 12 | 132.83 |
| Vehicle | 16 | 104.67 |
| Vehicle | 20 | 194.5 |
| 1.5 mg/kg modified FVIIa | 4 | 122.83 |
| 1.5 mg/kg modified FVIIa | 8 | 70.33 |
| 1.5 mg/kg modified FVIIa | 12 | 73 |
| 1.5 mg/kg modified FVIIa | 16 | 68.83 |
| 1.5 mg/kg modified FVIIa | 20 | 117.3 |
| 4.5 mg/kg modified FVIIa | 4 | 89.67 |
| 4.5 mg/kg modified FVIIa | 8 | 76.67 |
| 4.5 mg/kg modified FVIIa | 12 | 77.67 |
| 4.5 mg/kg modified FVIIa | 16 | 60.33 |
| 4.5 mg/kg modified FVIIa | 20 | 45.5 |

The results in the above examples demonstrate that the modified FVIIa provided herein, particularly those that are at least 4 or 5 times, such as at least 5 or 6 times, more potent than NovoSeven® FVIIa, can be used for on-demand therapy to treat bleeds from trauma, by subcutaneous administration following the trauma, also to treat expected bleeds, such as episodic bleeds and surgical bleeds, by pre-treatment prior to the expected bleed.

The results of the experiments in this example and the previous examples show that subcutaneous administration of the modified FVIIa as early as 15 minutes before injury significantly decreased bleeding in hemophilia A mice. Subcutaneous administration of modified FVIIa resulted in a dose dependent reduction in bleeding when administered to hemophilia A mice 15 minutes before injury. At the highest dose, full efficacy was achieved as bleeding in the treated mice was comparable to the blood loss observed in hemostatically competent normal mice. The ED5o for modified FVIIa was calculated to be 387 µg/kg after subcutaneous administration. When dosed as a rescue on-demand therapy one minute after injury, subcutaneous administration of the modified FVIIa significantly reduced bleeding to 350±46 µL from 635±50 µL (vehicle), p=0.02.

Patients with hemophilias, including Hemophilia A or B with and without inhibitors, lack treatment options that are fast and easy to use for treating acute bleeding. Their only options are intravenous administration of replacement or bypass therapies. These results show that modified FVIIa can be administered subcutaneously on-demand, before and after a bleed, such as bleeding from an injury, or to treat a bleed that a subject with these disorders can feel before it starts, such as a joint bleed. These data indicate that modified FVIIa that is more potent or active than the NovoSeven® FVIIa can be used on-demand to treat patients with acute bleeding or to prevent or reduce bleeding.

Example 4

Modified FVIIa Containing T128N/P129A/Q286R/M298Q FVIIa in Combination with Other Hemophilia Therapies Hemophilia patients treated with emicizumab (or emicizumab-kxwh, sold under the trademark Hemlibra® by Genentech) can experience breakthrough bleeds or require additional hemostatic coverage for procedures or surgery (see, e.g., page 116 in onlinelibrary.wiley.com/doi/epdf/10.1002/rth2.12227). Available therapies, including rFVIIa (Eptacog Alfa (Activated); NovoSeven® Factor VIIa) and aPCC (FEIBA®, sold by Takeda), have been used with Hemlibra® to treat bleeding or when additional coverage is required. Hemlibra® is a treatment for people with Hemophilia A (HA) with or without factor VIII inhibitors. NovoSeven® is a recombinant wild type Factor VIIa (FVIIa). FEIBA® is a Factor VIII (FVIII) inhibitor of bypass activity.

While NovoSeven® FVIIa appears safe in combination with Hemlibra® (HAVEN 1 to 4 clinical trials), thrombotic events have been observed with concurrent use of FEIBA and Hemlibra. While safe and efficacious when used as directed, NovoSeven® FVIIa must be infused intravenously. For patients on subcutaneous (SQ) treatment with Hemlibra, adjunct rFVIIa could also be dosed subcutaneously. The modified FVIIa polypeptides described herein, such as the FVIIa with the replacements T128N/P129A/Q286R/M298Q (denoted as T128N/P129A/Q286R/M298Q FVIIa), and others with similar activity or potency, can be subcutaneously administered to achieve pharmacologically relevant plasma concentrations. They can be subcutaneously administered on-demand either before an expected or episodic bleed or soon after a bleed. Thus, these modified FVIIa polypeptides provide a solution to address unmet needs in hemophilia therapy.

Figure 8:
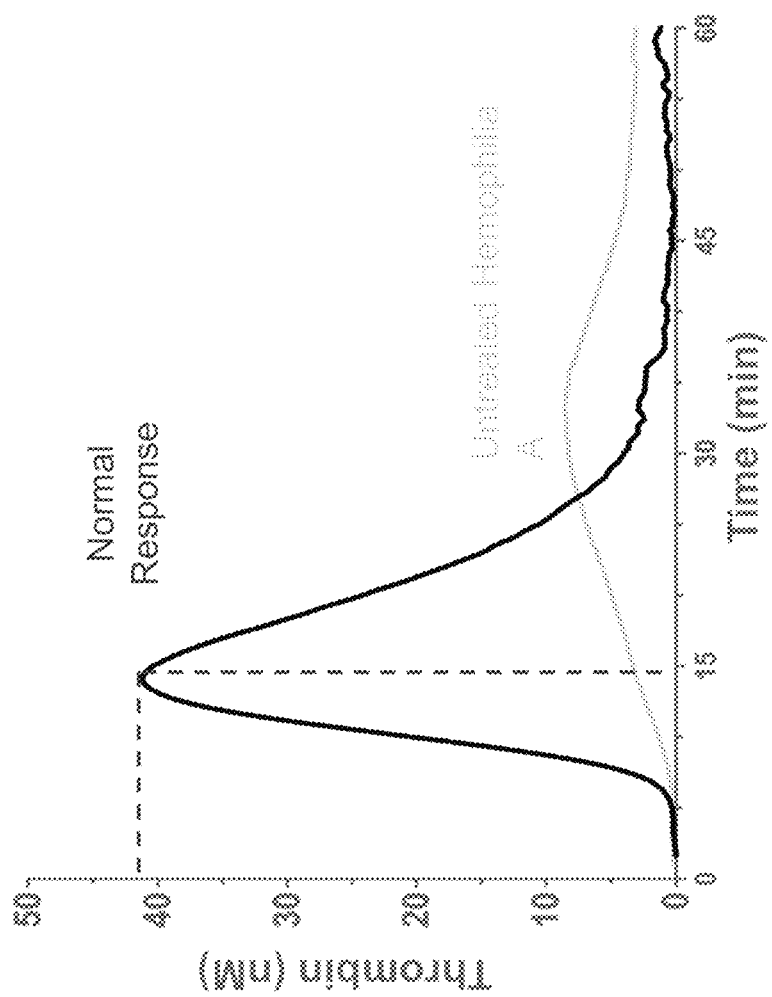
FIG. 8 depicts exemplary thrombin generation curves for a normal response and for an untreated Hemophilia A response.

FIG. 8 depicts exemplary thrombin generation curves for a normal response and for an untreated Hemophilia A (HA) response. The normal response is characterized by an initiation phase (lag-time) followed by the formation of large amounts of thrombin (propagation), next followed by a peak thrombin concentration, and next followed by inhibition of thrombin generation by natural anticoagulants (Castoldi and Rosing, 2011). Comparatively, the untreated HA response is flatter and with a lower peak thrombin generation, and with a longer time to reach a peak thrombin generation. The maximal thrombin generation can vary from donor to donor, and it may also depend on assay conditions; thus, often comparative experiments are run in the same matrix when performing an analysis of thrombin generation.

The thrombin generation assay was performed using standard PPP-Low Tissue Factor and phospholipid containing thrombin generation assay reagent (#TS31.00, Thrombinoscope, Stago). Single donor citrated hemophilia A plasma (George King Bio-Medical) was spiked with increasing concentrations of the test compounds as follows:
FEIBA®: 0.25 and 0.50 IU/mL
Hemlibra®: 0, 25, 50, and 100 µg/mL
NovoSeven® RT: 0, 1, 2.5, 5, 10, and 50 µg/mL
T128N/P129A/Q286R/M298Q FVIIa: 0, 0.1, 0.5, 1, 2.5, 5, and 10 µg/mL Pooled normal control plasma was included in the assay to set a "normalization" level of peak thrombin generation as compared with the HA samples that were spiked with FEIBA®, T128N/P129A/Q286R/M298Q FVIIa, or NovoSeven®.

Figure 9:
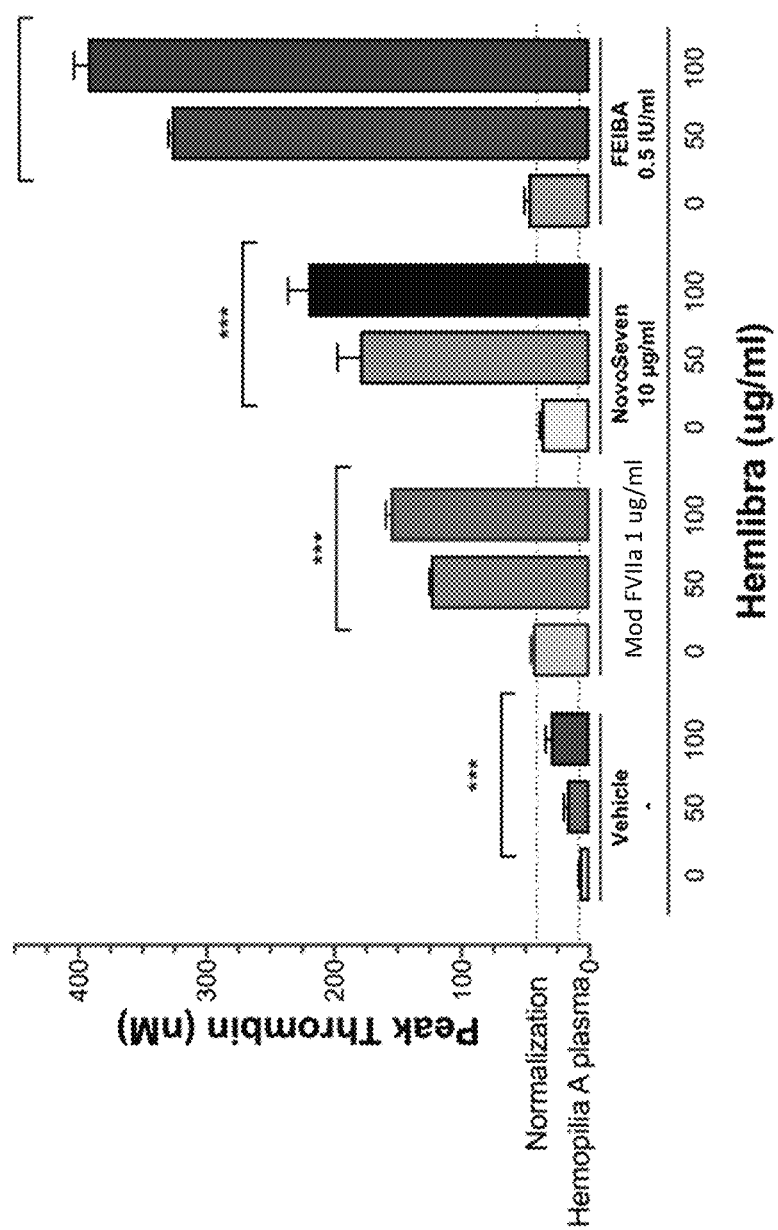
FIG. 9 depicts the effects of T128N/P129A/Q286R/M298Q FVIIa, NovoSeven®, or FEIBA® when in combination with Hemlibra®, on peak thrombin generation.
Figure 14:
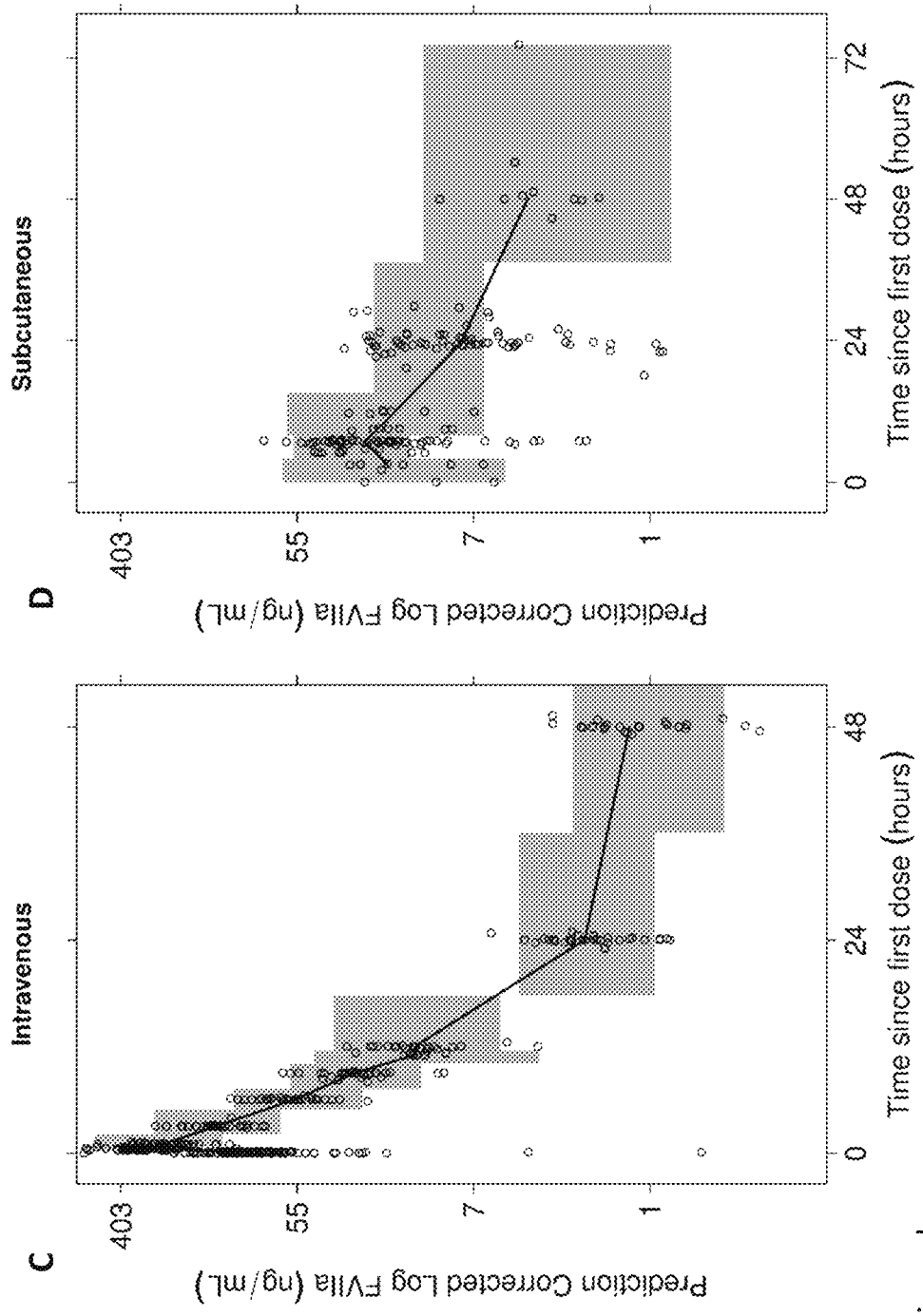
FIG. 14 depicts the results for simulation modeling using various dose groups of a T128N/P129A/Q286R/M298Q FVIIa, indicating that T128N/P129A/Q286R/M298Q FVIIa displays flip-flop pharmacokinetics, and that the simulation is in line with the clinical results using T128N/P129A/Q286R/M298Q FVIIa.

FIG. 9 depicts the effects of T128N/P129A/Q286R/M298Q FVIIa, NovoSeven®, or FEIBA® when in combination with Hemlibra®, on peak thrombin generation. The data shown is mean+SD for the buffer (vehicle), T128N/P129A/Q286R/M298Q FVIIa, NovoSeven®, and FEIBA®. Human plasma from a patient with congenital hemophilia A was treated with the T128N/P129A/Q286R/M298Q FVIIa, NovoSeven® FVIIa, or FEIBA®, with and without monoclonal antibody therapy with emicizumab-kxwh (Hemlibra®). FVIIa causes/supports thrombin generation in the absence of FVIII/FIX. Plasma concentrations are indicated below each test compound, and the HA plasma is of single donor origin.

Hemlibra® concentrations for the vehicle and each test compound are shown below the solid horizontal line. The dotted lines represent peak thrombin generation levels in the HA plasma (lower line), and in a pooled plasma from healthy individuals (upper line). The asterisks indicate difference from FEIBA® at 0.5 IU/mL. It was not possible to go above 0.5 IU/mL FEIBA® as it exhausted the assay limits. Data represent duplicate or triplicate experiments run on separate occasions with the same lot of plasma and with each sample run in triplicate within each experiment. Control samples were included on each plate in each experiment. These results are also summarized in Table 5 below.

Peak thrombin levels (nM) were measured from the above subjects. In this assay, the data show that the modified FVIIa exhibits about 10-fold increased potency compared to NovoSeven® FVIIa.

TABLE 5

Modified FVIIa containing T128N/P129A/Q286R/M298Q FVIIa exhibits profile similar to FDA approved FVIII inhibitor bypass drug

| Treatment | emicizumab-kxwh (µg/mL) | Peak thrombin (nM) |
| --- | --- | --- |
| Vehicle | 0 | 8.16 |
| Vehicle | 50 | 17.94 |
| Vehicle | 100 | 30.85 |
| 1 µg/mL modified FVIIa | 0 | 44.58 |
| 1 µg/mL modified FVIIa | 50 | 124.35 |
| 1 µg/mL modified FVIIa | 100 | 156.20 |

TABLE 5-continued

Modified FVIIa containing T128N/P129A/Q286R/M298Q FVIIa exhibits profile similar to FDA approved FVIII inhibitor bypass drug

| Treatment | emicizumab-kxwh (µg/mL) | Peak thrombin (nM) |
| --- | --- | --- |
| 10 µg/mL NovoSeven ® FVIIa | 0 | 37.81 |
| 10 µg/mL NovoSeven ® FVIIa | 50 | 180.03 |
| 10 µg/mL NovoSeven ® FVIIa | 100 | 220.61 |
| 0.5 IU/mL FEIBA Anti-Inhibitor Coagulant Complex | 0 | 48.30 |
| 0.5 IU/mL FEIBA Anti-Inhibitor Coagulant Complex | 50 | 327.59 |
| 0.5 IU/mL FEIBA Anti-Inhibitor Coagulant Complex | 100 | 393.09 |

Example 5

Pharmacokinetics of Subcutaneously and Intravenously Administered T128N/P129A/Q286R/M298Q FVIIa in Human Subjects T128N/P129A/Q286R/M298Q FVIIa (SEQ ID NO: 280) was administered either intravenously (IV) or subcutaneously (SQ) to subjects diagnosed with either Hemophilia A or B (HA or HB) with inhibitors. Inhibitors are neutralizing antibodies developed in HA or HB subject, against wild type FVIII or FIX in response to factor replacement therapy. Pharmacokinetic assessments were completed at various time points following subcutaneous or intravenous administration. Subcutaneously administered modified FVIIa, such as T128N/P129A/Q286R/M298Q FVIIa, has increased half-life compared to modified FVIIa that is intravenously administered.

A. Methods

Eligible subjects were males 18 years and older who have severe congenital Hemophilia A or B with an inhibitor, and a history of frequent bleeding episodes during the 6 months prior to enrollment. Exclusion criteria included: receiving prophylaxis treatment, previous participation in a clinical trial evaluating a modified rFVIIa agent, known positive antibody to FVII or FVIIa detected by central laboratory at screening; presence of a coagulation disorder other than hemophilia A or B, or significant contraindication to participation.

10 subjects with hemophilia and with a documented annual bleeding rate of >12 were enrolled in the study. 9 subjects completed the study. One subject did not complete the study due to a serious adverse event (SAE) unrelated to administration of the modified FVIIa containing the replacements T128N/P129A/Q286R/M298Q.

30 µg/kg of the modified FVIIa containing the replacements T128N/P129A/Q286R/M298Q was administered subcutaneously or intravenously to subjects one time at T=0. Blood was collected once every 3 hours for 24 hours post-dosing. The half-life and additional pharmacokinetic and coagulation parameters of subcutaneously or intravenously administered FVII protein were determined as detailed in Example 9, above.

B. Results

The results are set forth in Table 6, below. The data and results show that administering T128N/P129A/Q286R/

M298Q FVIIa subcutaneously to subjects with Hemophilia A or B with an inhibitor increases the apparent half-life of the drug to 16.6 hours, compared to a half-life of 3.6 hours for intravenous administration.

TABLE 6

Pharmacokinetic results after IV or SQ administration

| | Half-life alpha (hr) | Half-life beta (hr) | Mean Residence Time (hr) | Cmax (ng/mL) | Tmax (hr) | $AUC_{0-t}$ (ng/mL · hr) | $AUC_{0-\infty}$ (ng/mL · hr) | Bioavailability |
|---|---|---|---|---|---|---|---|---|
| IV Median ± Interquartile Range | 1.8 ± 1.1 | 3.6 ± 0.7 | 4.0 ± 2.2 | 332.7 ± 181.8 | 0.083 ± 0 | 1042 ± 456 | 1048 ± 473 | 33.0 ± 27.0% |
| SQ Median ± Interquartile Range | | 16.6 ± 15.2 | 26.4 ± 22.0 | 31.1 ± 20.9 | 7 ± 4 | 429 ± 534 | 449 ± 663 | | half-life alpha = half-life for the redistribution phase;
half-life beta = half-life for the elimination phase (i.e., elimination due to metabolism);
Cmax = Maximum concentration after dosing;
Tmax = time when Cmax is reached;
$AUC_{0-t}$ = Exposure;
$AUC_{0-\infty}$ = Exposure Example 6

Pharmacokinetics of Subcutaneously and Intravenously Administered Modified FVIIa in Normal Mice Two modified FVIIa variants, T128N/P129A/Q286R/M298Q FVIIa (SEQ ID NO: 280) and Q286R/M298Q FVIIa (SEQ ID NO: 138), and the unmodified recombinant human FVIIa (rFVIIa, SEQ ID NO: 3) were used in pharmacokinetic studies using subcutaneous (SQ) or intravenous (IV) administration to normal mice without hemophilia. Q286R/M298Q FVIIa does not include the added N-terminal glycosylation site found in the T128N/P129A/Q286R/M298Q FVIIa polypeptide.

Pharmacokinetic assessments were completed at various time points following subcutaneous or intravenous administration. Subcutaneously administered modified FVIIa, such as T128N/P129A/Q286R/M298Q FVIIa, showed an increased half-life compared to modified FVIIa that is intravenously administered.

A. Methods

Eight-week-old CD-1 male mice were obtained and acclimatized for at least three days under standard housing conditions with normal chaw and water ad libitum, in a twelve hour day/twelve hour night cycle. Fasting before experimental day was not required.

Subcutaneous Study Methods

For SQ administration, the modified FvIIa variants were provided in a stock concentrations of 2.1 mg/ml as the test articles. On the experimental day, the test articles were thawed and diluted with buffer to 0.3 mg/ml. For IV administration, the test articles were also provided in a stock concentration. The buffer solution for dilution was 10 mM L-Histidine, 29 mM sucrose, 390 mM glycine, 10 mM calcium chloride dihydrate, 3.35 mM L-methionine, 0.03% Tween 80, with pH 6.0. All test articles and solutions were stored at −80° C.

For the SQ study, the test solution was injected in the interscapular area of the neck in a dose of 1.5 mg/kg applied in a dose volume of 5 ml/kg. Mice were divided into seven sets of three for each compound tested. A sparse sampling approach of two blood samples from each mouse was used. The first blood sample was drawn from the facial vein, and the second blood sample was collected at termination via cardiac stick following CO2 inhalation. The sets and the times at which each sample was taken (pre-dose, or time post-dosing) are presented in Table 7 below.

TABLE 7

Sample Collection Times For Experimental Mouse Sets

| | Set A | Set B | Set C | Set D | Set E | Set F | Set G |
|---|---|---|---|---|---|---|---|
| Sample 1 | Pre-dose | 0.083 hr | 0.25 hr | 0.5 hr | 0.75 hr | 1 hr | 1.5 hr |
| Sample 2 | 2 hrs | 3 hrs | 4 hrs | 5 hrs | 6 hrs | 12 hrs | 24 hrs |

Animal 1 from each set, animal 2 from each set, and animal 3 from each set were grouped together to obtain three plasma concentration-time curves for pharmacokinetic (PK) fitting. These are referred to as groups 1, 2, and 3, respectively.

Intravenous Study Methods

For the IV study, five CD-1 mice received an IV bolus injection of 0.1 mg/kg in a lateral tail vein. Serial blood samples were then obtained from the mice at 5, 15, 30, 60, and 120 minutes post-injection. The blood samples were collected into tubes containing 129 mM citrate stock solution, to make a solution of 1 part citrate stock solution to 9 parts blood. The mixing of the blood sample to the citrate stock solution was performed by gentle pipetting five times. The samples were then stored on wet ice until process to plasma by centrifugation (4000×g for 5 minutes at 4° C. within 30 minutes of collection). The plasma samples were then transferred into 25 µl aliquots on wet ice, transferred into separate 96 well plates (matrix tubes) and stored at −80° C.

Analysis

For analysis of the plasma concentrations of clot activity, the plasma samples were analyzed by the STACLOT® assay (Stago Diagnostica), similar to the analysis described in Example 9 above. The clots activities were back-transformed into ng/ml by use of a rFVIIa standard curve (NovoSeven® standard curve). Thus, the results discussed below are reported against the NovoSeven® standard curve.

For pharmacokinetic analysis, drug concentration-time data were analyzed by non-compartmental methods with extravascular absorption (model #101) or IV bolus (model #102) using the add-in program PKSolver in Microsoft Excel 2.0. The analysis performed was similar to the analysis described in Example 9 above. Three to five data points were automatically selected by the PKSolver program for estimation of the terminal elimination half-life.

One mouse in the rFVIIa group showed a measurable, but low, plasma concentration at 24 hours that was of the same magnitude as the plasma concentration at 12 hours. Therefore, the 24-hour result was excluded from the data analysis.

Figures and statistical analyses were prepared in Graph Pad Prism 8.0. The results are presented as the mean and standard deviation (SD) unless otherwise stated.

B. Results

FIGS. 10-12 depict the plasma concentrations of T128N/P129A/Q286R/M298Q FVIIa, Q286R/M298Q FVIIa, and rFVIIa (NovoSeven®), respectively, following SQ injection of 1.5 mg/kg to CD-1 mice. Panel A of FIGS. 10-12 depict an arithmetic scale, and Panel B of FIGS. 10-12 depict a logarithmic scale. All three proteases were rapidly absorbed from the subcutaneous depot with maximum peak concentration (Tmax) occurring at about 2 hours after administration.

The maximum plasma concentrations (Cmax) was 750.3±145.8 ng/ml, 409.8±169.7 ng/ml, and 248.0±48.3 ng/ml for T128N/P129A/Q286R/M298Q FVIIa, Q286R/M298Q FVIIa, and rFVIIa, respectively (P<0.007, ANOVA). The mean difference of Cmax between T128N/P129A/Q286R/M298Q FVIIa and Q286R/M298Q FVIIa was 340.5 ng/ml (24,96 to 656,0 ng/ml, 95% C.I.) and 530.7 ng/ml (215,2 to 846,2 ng/ml, 95% C.I.).

The apparent terminal elimination half-life ($T^{1/2}$) was 4.53±0.03 hours (h), 3.16±0.27 h, and 3.19±0.62 h for T128N/P129A/Q286R/M298Q FVIIa, Q286R/M298Q FVIIa, and rFVIIa, respectively (P<0.008, ANOVA). The mean difference of $T^{1/2}$ between T128N/P129A/Q286R/M298Q FVIIa and the Q286R/M298Q FVIIa was 1.37 h (0.43 to 2.3 h, 95% C.I.), and between T128N/P129A/Q286R/M298Q FVIIa and rFVIIa, the mean difference of $T^{1/2}$ was 1.34 h (0.40 to 2.3 h, 95% C.I.).

The T128N/P129A/Q286R/M298Q FVIIa polypeptides stayed in the body longer when compared to the Q286R/M298Q FVIIa and rFVIIa polypeptides, with a mean residence time (MRT) of 7.01±0.29 h. The MRT was 5.64±0.08 h and 5.53±0.74 h (P<0.012) for Q286R/M298Q FVIIa and rFVIIa, respectively. The mean difference of MRT between T128N/P129A/Q286R/M298Q FVIIa and Q286R/M298Q FVIIa was 1.37 h (0.29 to 2.4 h, 95% C.I.), and the mean difference of MRT between T128N/P129A/Q286R/M298Q FVIIa and rFVIIa was 1.48 h (0.40 to 2.56 h, 95% C.I.).

The estimated PK parameters of T128N/P129A/Q286R/M298Q FVIIa, Q286R/M298Q FVIIa, and rFVIIa after SQ administration 1.5 mg/kg to CD-1 mice are presented in Table 8 below. The raw data from these studies are presented in Table 9 below.

TABLE 8

Estimated Pharmacokinetic Parameters, Subcutaneous Injection

| Pharmacokinetic parameter | Group 1 | Group 2 | Group 3 | Mean | SD |
|---|---|---|---|---|---|
| T128N/P129A/Q286R/M298Q FVIIa | | | | | |
| Ke ($h^{-1}$) | 0.1533 | 0.1517 | 0.1539 | 0.1529 | 0.0011 |
| T½ (h) | 4.52 | 4.57 | 4.51 | 4.53 | 0.032 |
| Tmax (h) | 2 | 2 | 2 | 2 | N.A |
| Cmax (ng/ml) | 853.3 | 583.5 | 814.1 | 750.3 | 145.8 |
| AUC 0-inf_obs (h*µg/ml) | 4.41 | 4.66 | 5.14 | 4.74 | 0.37 |
| MRT 0-inf_obs (h) | 7.18 | 7.17 | 6.67 | 7.01 | 0.29 |
| Vz/F_obs (ml/kg) | 2,219 | 2,120 | 1,897 | 2,079 | 165 |
| CL/F-obs(ml/h/kg) | 340 | 322 | 292 | 318 | 24.2 |
| Q286R/M298Q FVIIa | | | | | |
| Ke ($h^{-1}$) | 0.2076 | 0.2110 | 0.2433 | 0.2206 | 0.0197 |
| T½ (h) | 3.34 | 3.29 | 2.85 | 3.16 | 0.27 |
| Tmax (h) | 2 | 2 | 1.5 | 1.8 | 0.3 |
| Cmax (ng/ml) | 342.9 | 602.7 | 472.2 | 472.6 | 129.9 |
| AUC 0-inf_obs (h*µg/ml) | 1.77 | 2.22 | 2.28 | 2.09 | 0.28 |
| MRT 0-inf_obs (h) | 5.55 | 5.65 | 5.71 | 5.64 | 0.08 |
| Vz/F_obs (ml/kg) | 4,083 | 3,202 | 2,710 | 3,332 | 696 |
| CL/F-obs(ml/h/kg) | 848 | 676 | 659 | 728 | 105 |
| rFVIIa | | | | | |
| Ke ($h^{-1}$) | 0.2167 | 0.1826 | 0.2707 | 0.2233 | 0.0444 |
| T½ (h) | 3.20 | 3.80 | 2.56 | 3.19 | 0.62 |
| Tmax (h) | 3 | 1 | 3 | 2.3 | 1.2 |
| Cmax (ng/ml) | 293.8 | 317.9 | 252.5 | 288.1 | 33.1 |
| AUC 0-inf_obs (h*µg/ml) | 1.74 | 1.63 | 1.58 | 1.65 | 0.08 |
| MRT 0-inf_obs (h) | 5.80 | 6.10 | 4.70 | 5.53 | 0.74 |
| Vz/F_obs (ml/kg) | 3,969 | 5,038 | 3,514 | 4,174 | 782 |
| CL/F-obs(ml/h/kg) | 860 | 920 | 951 | 910 | 46 |

TABLE 9

Raw Data of Estimated Pharmacokinetic Parameters Studies

| Hours | T128N/P129A/Q286R/M298Q FVIIa (ng/ml) | | | Second Modified FVIIa (ng/ml) | | | rFVIIa (ng/ml) | | |
|---|---|---|---|---|---|---|---|---|---|
| 0.083 | 95.76 | 70.2 | 89.93 | 49.65 | 24.32 | 35.75 | 50.56 | 55.55 | 26.9 |
| 0.25 | 84.26 | 137.3 | 106.1 | 30.89 | 41.88 | N.A. | 69.2 | 48.01 | 58.39 |
| 0.5 | 417 | 287.5 | 207.2 | 126.1 | 121.8 | 129.9 | 70.86 | 103.2 | 94.48 |
| 0.75 | 420.2 | 378 | 370.2 | 311.1 | 112.7 | 172.3 | 196.6 | 186.7 | 143.9 |
| 1 | 433.9 | 412.2 | 591 | 247 | 269.6 | 268.8 | 176.6 | 317.9 | 174.7 |
| 1.5 | 609.4 | 478.7 | 573.9 | 225.6 | 332.8 | 472.2 | 185.2 | 205.8 | 208.4 |
| 2 | 853.3 | 583.5 | 814.1 | 342.9 | 602.7 | 283.8 | 222.2 | 184.8 | 251.7 |
| 3 | 298 | 469.5 | 394.8 | 169.2 | 146.5 | 166.8 | 293.8 | 197.6 | 252.5 |
| 4 | 233.3 | 324.9 | 429.3 | 85.47 | 97.27 | 102.7 | 158 | 166.8 | 206.4 |
| 5 | 484.2 | 313.4 | 511.5 | 165.3 | 251 | 437.1 | 178.5 | 149.5 | 182.2 |
| 6 | 227.6 | 314.2 | 344.6 | 132.6 | 153.5 | 147.1 | 137 | 111.5 | 98.66 |
| 12 | 131.4 | 129 | 115.4 | 38.45 | 51.45 | 57.5 | BLQ | BLQ | 23.42 |
| 24 | BLQ | 20.55 | 20.88 | BLQ | BLQ | BLQ | BLQ | BLQ | (21.39) |

Number in Parentheses Excluded. BLQ: Below Limit of Quantification

FIG. 13 depicts the plasma concentration of following intravenous bolus injection of the T128N/P129A/Q286R/M298Q FVIIa polypeptide to CD-1 mice. Panel A of FIG. 13 depicts an arithmetic scale, and panel B of FIG. 13 depicts a logarithmic scale. The single dose IV bolus injection was at 0.1 mg/kg. T128N/P129A/Q286R/M298Q FVIIa was rapidly cleared from plasma with a $T^{1/2}$ of 41±3.9 minutes. The PK parameters of this study are presented in Table 10A below.

As shown in FIGS. 10-11, the plasma concentrations of T128N/P129A/Q286R/M298Q FVIIa and Q286R/M298Q FVIIa were measured to be low at 3 and 4 hours post-dosing, respectively. These data points were not considered to severely influence the estimation of the terminal elimination rate constant, and thus $T^{1/2}$, because this parameter was estimated by using the plasma concentrations beyond these two data points. However, the calculated area under the plasma concentration-time curve from 0 to infinity (AUC0-inf) after the SQ administration of T128N/P129A/Q286R/M298Q FVIIa may be reduced and therefore affect the calculation of the bioavailability (F). The average bioavail-

TABLE 10A

Estimated Pharmacokinetic Parameters: Intravenous Injection T128N/P129A/Q286R/M298Q FVIIa

| PK Parameter | ID 2 | ID 4 | ID 6 | ID 7 | ID 8 | Mean | SD | SEM |
|---|---|---|---|---|---|---|---|---|
| Ke(min$^{-1}$) | 0.0149 | 0.0179 | 0.0174 | 0.0188 | 0.0159 | 0.0170 | 0.00158 | 0.000704 |
| t1/2 (min) | 46.39 | 38.64 | 39.76 | 36.83 | 43.73 | 41.07 | 3.90 | 1.75 |
| Tmax (min) | 5 | 5 | 5 | 5 | 5 | 5 | 0 | 0 |
| Cmax (μg/ml) | 2.34 | 1.79 | 1.81 | 2.56 | 2.38 | 2.18 | 0.35 | 0.156 |
| C0 (μg/ml) | 2.70 | 2.00 | 2.40 | 3.24 | 2.53 | 2.57 | 0.45 | 0.20 |
| Clast_obs/Cmax | 0.128 | 0.128 | 0.116 | 0.0936 | 0.169 | 0.127 | 0.0272 | 0.0122 |
| AUC 0-t (μg/ml*min) | 112.5 | 91.97 | 93.22 | 118.9 | 133.6 | 110.0 | 17.67 | 7.90 |
| AUC 0-inf_obs (μg/ml*min) | 132.6 | 104.8 | 105.3 | 131.6 | 158.9 | 126.6 | 22.5 | 10.1 |
| AUC 0-t/0-inf_obs | 0.848 | 0.878 | 0.885 | 0.903 | 0.841 | 0.871 | 0.0259 | 0.0116 |
| AUMC 0-inf_obs (μg/ml*min^2) | 7,898 | 5,610 | 5,773 | 6,464 | 9,791 | 7,107 | 1,751 | 782.8 |
| MRT 0-inf_obs (min) | 59.6 | 53.6 | 54.8 | 49.1 | 61.6 | 55.7 | 4.97 | 2.22 |
| Vz_obs (ml/kg) | 50.5 | 53.2 | 54.5 | 40.4 | 39.7 | 47.6 | 7.09 | 3.17 |
| Cl_obs (ml/min/kg) | 0.75 | 0.95 | 0.95 | 0.76 | 0.63 | 0.81 | 0.140 | 0.0626 |
| Vss_obs (ml/kg) | 44.9 | 51.1 | 52.1 | 37.3 | 38.8 | 44.8 | 6.80 | 3.04 |

The terminal elimination half-life of the T128N/P129A/Q286R/M298Q FVIIa polypeptide was shown to be faster after intravenous injection than after subcutaneous injection T128N/P129A/Q286R/M298Q. FVIIa may therefore follow flip-flop pharmacokinetics with the absorption being much slower than the elimination of the drug from the body. Thus, the prolonged half-life seen after SQ injection reflects the absorption rate from the administration depot.

ability F of T128N/P129A/Q286R/M298Q FVIIa following SQ administration in CD-1 mice can be calculated by the following equation:

$$F = AUC0\text{-}inf,sc / AUC0\text{-}inf,iv * Div/Dsc = 15.0\% (12.1\%\text{-}17.8\%, 95\% \; C.I.)$$

The results of the pharmacokinetic studies showed that subcutaneous administration of T128N/P129A/Q286R/M298Q FVIIa in normal CD-1 mice resulted in a prolonged half-life, showing about a 6-fold increase as compared to when the compound was administered intravenously. The average SQ bioavailability was estimated to be about 15%.

Example 7

Population Pharmacokinetics of Subcutaneously and Intravenously Administered Modified FVIIa Population pharmacokinetics (PopPK, or population PK) of intravenous (IV) and subcutaneous (SQ) administration of the modified FVIIa polypeptide, T128N/P129A/Q286R/M298Q FVIIa, was modeled and characterized to further inform dose selection, using simulations of varying dose regimens. The simulations were performed for adult human subjects, and included simulations for adults with hemophilia A (HA) or hemophilia B (HB), or Factor VII deficiency (FVIID).

A. Methods

The activity of T128N/P129A/Q286R/M298Q FVIIa, analyzed as T128N/P129A/Q286R/M298Q FVIIa exposure data, was evaluated after single IV doses (4.5, 9, 18 and 30 ug/kg) and single IV (18 ug/kg) and SQ doses (30 and 60 ug/kg). Non-linear mixed-effects modelling was used to sequentially model the data describing both the IV and SQ data, including non-linearities and allometric scaling. Model discrimination was based on parameter uncertainty, plausibility and changes in the objective function value ($\Delta OFV=-3.84$, $p<0.05$, one degree of freedom). The simulations were conducted for a 70 kg adult subject.

A first population PK model (referred to as MAA-POPPK-001) was developed based on available clinical trial data, of intravenous and subcutaneous dosing data. Additional modeling was also performed using a second population PK model developed and based on the first model (referred to as MAA-POPPK-002).

B. Results

FIGS. 14A-14D depict the visual predictive check for the T128N/P129A/Q286R/M298Q FVIIa concentrations across all dose groups, showing the final PopPK model resulting from the simulations. The open circles represent individual observations. The solid line represents the median of the observed data. The shaded area represents the 95% confidence interval of the simulated data based on 1000 simulations. These results described the clinical data shown by T128N/P129A/Q286R/M298Q FVIIa, described in the examples above.

FIG. 15A depicts the results of clinical trial simulations using a 70 kg adult, using 3 different subcutaneous T128N/P129A/Q286R/M298Q FVIIa treatment regimens. The solid black line is the simulated concentration of T128N/P129A/Q286R/M298Q FVIIa. The black long-dashed lines represent target levels (24 to 120 ng/ml) as defined for T128N/P129A/Q286R/M298Q FVIIa in hemophilia A (HA) and hemophilia B (HB) with inhibitors. The black dash-dotted line represents the T128N/P129A/Q286R/M298Q FVIIa activity level, equivalent to Cmax after 270 µg/kg rFVIIa (NovoSeven®) IV (3,000 ng/ml), assuming 10× increased potency of T128N/P129A/Q286R/M298Q FVIIa, as documented in thrombin generation experiments conducted using T128N/P129A/Q286R/M298Q FVIIa and rFVIIa, in human hemophilia A plasma.

The subcutaneous bioavailability of T128N/P129A/Q286R/M298Q FVIIa was estimated at 33%, with inter-individual variability of 76%. The terminal elimination half-life for IV dosing was estimated at 3.3 hours, and the absorption and elimination SQ half-lives were both estimated to be 11.8 hours, indicating flip-flop pharmacokinetics. The simulations indicated that daily dosing, as well as multiple dosing such as twice and three times in 24 hours (every 3-6 hours in a 24 hour period, such as at 0, 3, and 6 hours at a dose of 60, 90, and 120 µg/kg) achieved exposures within or above the target range. Using a 60 µg/kg dose, T128N/P129A/Q286R/M298Q FVIIa may be administered three times in a 24 hour period without significantly exceeding the defined target range, as depicted in FIG. 15A. Thus, target levels for haemostasis may be achieved with the dosing regimen of 60 µg/kg SQ dose with 1-3 doses in 24 hours.

Figures 15B, 15C:
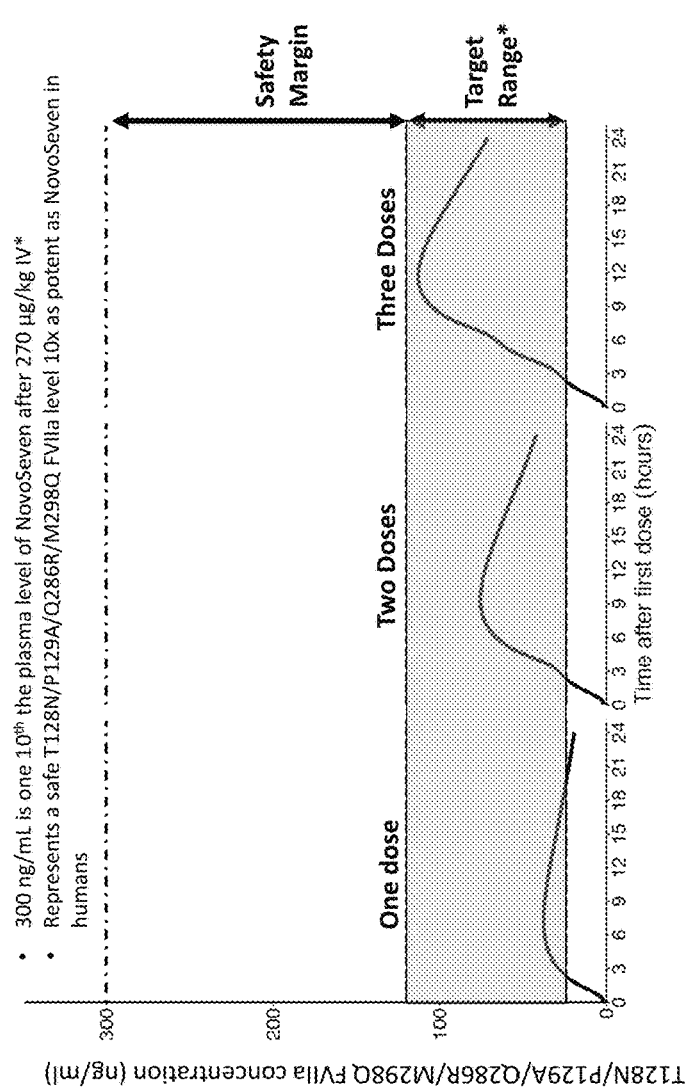
FIGS. 15B-15C depicts a graph of the results of clinical trial population pharmacokinetic simulations, using one, two, or three subcutaneous doses of T128N/P129A/Q286R/M298Q FVIIa, and a summary of the dosing regimen and resulting calculations, respectively.

FIGS. 15B-15C depicts a graph of the results of clinical trial population pharmacokinetic simulations, using one, two, or three doses of T128N/P129A/Q286R/M298Q FVIIa polypeptide, and a summary of the dosing regimen and resulting calculations, respectively. These simulations of a population of 1000 were optimized from real data sets from patients, and showed a coverage of the proposed Cmax and AUC subcutaneous dosing regimen of up to three doses of 60 µg/kg for over six hours. Subjects with hemophilia have been safely exposed to average Cmax and AUC levels of 815 ng/mL and 2788 ng*hr/mL. The percentage of individuals showing a T128N/P129A/Q286R/M298Q FVIIa polypeptide concentration above the target range after various time points, using the MAA-POPPK-001 model, is summarized in Table 10B below.

Further clinical trial simulations were next conducted for a population of one thousand virtual subjects with hemophilia weighing 40 to 105 kg, using the MAA-POPPK-002 model. Additional dosing regimens were simulated, and the secondary PK parameters measured were as follows: maximal concentration ($C_{max}$), time to maximum concentration ($T_{max}$), minimal concentration ($C_{min}$) and area under the concentration versus time curve (AUC) between 0-24 hours. The simulated population PK profiles were compared to a pre-defined target range for each of the two patient populations. Furthermore, the time to target and the fraction of the population above target at various time points for the different dosing regimens were calculated. Tables 10C-10D summarize the predicted pharmacokinetics after different dosing regimens in adult subjects, using the MAA-POPPK-002 model.

The modeling showed that, in subjects with hemophilia, bioavailability of the T128N/P129A/Q286R/M298Q FVIIa polypeptide after subcutaneous (SQ) administration was estimated to be 26% with inter-individual variability (IIV) of 54%. Terminal elimination half-life was estimated through simulations to be 3.3 hours after intravenous (IV) administration. Absorption half-life after SQ administration was estimated to be 12.9 hours with IIV of 30%, indicating flip-flop kinetics. Terminal elimination half-life after SQ administration was estimated to be a median of 15.5 hours and 12.9 hours in hemophilia and Factor VII deficiency (FVIID), respectively.

The median time to reach target (24 ng/mL) was 2.2 hours following single dose administration of 60 µg/kg in subjects with hemophilia. The hemophilia simulations indicated that 51% of the population reached target levels 3 hours after a single dose of 60 µg/kg. Similarly, 70%, 90% and 91% of subjects were above target 6 hours after 60 µg/kg dosed once, twice or three times at 3 hourly intervals, respectively.

After 24 hours 33%, 81% and 96% of the subjects remained above target following 60 µg/kg once, twice or three times, respectively.

In FVIID, the simulated median times to reach target (2 ng/mL) were 1.5, 1.2 and 0.8 hours following single SQ injections of the T128N/P129A/Q286R/M298Q FVIIa polypeptide at 20, 30 or 60 µg/kg, respectively. A single dose of 20 µg/kg resulted in 80%, 90% and 68% of the patients being above the target 3, 6, and 24 hours after dosing. Further increasing the dose to 30 or 60 µg/kg resulted in 98% to 100% of the population reaching target levels within 6 hours after dosing.

TABLE 10B

Population Pharmacokinetics and Percentage of 1000 Individuals Simulated Above Target Range

| Dosing Regimen | Above target after 1 hour | Above target after 3 hours | Above target after 6 hours | Above target after 9 hours | Above target after 12 hours | Above target after 24 hours | Above target after 36 hours | Above target after 48 hours |
|---|---|---|---|---|---|---|---|---|
| 60 µg/kg, once; dose: 0 hours | 10% | 53% | 73% | 72% | 70% | 32% | 6% | 0.5% |
| 60 µg/kg twice; dose: 0 and 3 hours | 7% | 56% | 92% | 96% | 96% | 82% | 42% | 11% |
| 60 µg/kg three times; dose: 0, 3, and 6 hours | 7% | 58% | 93% | 98% | 99% | 96% | 72% | 32% |

TABLE 10C

Predicted T128N/P129A/Q286R/M298Q FVIIa Pharmacokinetics, After Different Phase 3 Regimens in Adults with HA/HB

| Regimen (dosing time in hours) | Median $C_{max24h}$ (80% PI) ng/mL | Median $T_{max24h}$ (80% PI) hours | Median $C_{min24h}$ (80% PI) ng/mL | Median $AUC_{0-24h}$ (80% PI) h*ng/mL |
|---|---|---|---|---|
| 60 ug/kg QD (t = 0) | 34.5 (17.6-68.5) | 7.8 (5.3-11.1) | 19.3 (10.7-35.2) | 604 (310-1190) |
| 60 ug/kg BID (t = 0, t = 3) | 68.7 (35.1-125.1) | 9.5 (7.1-13.0) | 40.4 (21.0-70.6) | 1166 (602-2081) |
| 60 ug/kg TID (t = 0, t = 3, t = 6) | 106.1 (51.3-201.1) | 11.6 (8.7-14.8) | 66.7 (34.9-122.9) | 1715 (852-3210) |
| 60 ug/kg BID (t = 0, t = 6) | 67.2 (33.5-123.8) | 11.9 (9.0-15.5) | 43.5 (22.8-75.4) | 1098 (565-1981) |
| 60 ug/kg TID (t = 0, t = 6, t = 12) | 100.1 (48.2-186.7) | 16.6 (12.1-20.1) | 77.0 (39.5-138.8) | 1483 (738-2782) |

Abbreviations:
$AUC_{0-24h}$ = area under concentration versus time curve between 0 to 24 hours;
$C_{max}$ = maximum or peak concentration;
Tmax = the time at which Cmax is achieved.

TABLE 10D

Predicted T128N/P129A/Q286R/M298Q FVIIa Pharmacokinetics, After Different Dosing Regimens in Adult FVIID Subjects

| Regimen (dosing time in hours) | Median $C_{max24h}$ (80% PI) ng/mL | Median $T_{max24h}$ (80% PI) hours | Median $C_{min24h}$ (80% PI) ng/mL | Median $AUC_{0-24h}$ (80% PI) h*ng/mL |
|---|---|---|---|---|
| 10 ug/kg QD (t = 0) | 2.4 (1.2-4.8) | 7.8 (5.3-11.1) | 1.3 (0.7-2.5) | 43.8 (22.5-86.3) |
| 20 ug/kg QD (t = 0) | 4.8 (2.4-9.7) | 7.8 (5.3-11.1) | 2.6 (1.4-4.9) | 87.5 (44.9-173) |
| 30 ug/kg QD (t = 0) | 7.3 (3.7-14.5) | 7.8 (5.3-11.1) | 4.0 (2.1-7.4) | 131.3 (67.4-259) |
| 60 ug/kg QD (t = 0) | 14.5 (7.3-29.0) | 7.8 (5.3-11.1) | 7.9 (4.2-14.8) | 262.5 (135-518) |
| 20 ug/kg BID (t = 0, t = 3) | 9.8 (4.8-18.0) | 9.4 (7.1-13.0) | 5.6 (2.9-10.1) | 169.1 (87.3-302) |
| 20 ug/kg BID (t = 0, t = 6) | 9.5 (4.7-17.8) | 11.9 (9.0-15.5) | 6.0 (3.2-10.8) | 159.1 (82-287) |
| 20 ug/kg TID (t = 0, t = 3, t = 6 hrs) | 15.2 (7.3-29.0) | 11.6 (8.7-14.9) | 9.5 (4.9-17.6) | 248.7 (124-465) |

TABLE 10D-continued

Predicted T128N/P129A/Q286R/M298Q FVIIa Pharmacokinetics, After Different Dosing Regimens in Adult FVIID Subjects

| Regimen (dosing time in hours) | Median $C_{max24h}$ (80% PI) ng/mL | Median $T_{max24h}$ (80% PI) hours | Median $C_{min24h}$ (80% PI) ng/mL | Median $AUC_{0-24h}$ (80% PI) h*ng/mL |
|---|---|---|---|---|
| 20 ug/kg TID (t = 0, t = 6, t = 12) | 14.4 (6.9-27.0) | 16.6 (12.1-20.1) | 10.9 (5.5-20.0) | 215.1 (107-404) |

These results support that one, two, or three subcutaneous doses of T128N/P129A/Q286R/M298Q FVIIa at 60 µg/kg can be efficacious for 24 hours before clearance in the subject. The option of re-dosing or re-treating also allows for individual tailoring of the dosing regimen to optimize the use of the T128N/P129A/Q286R/M298Q FVIIa as needed by an individual. These simulations also show a prediction of extended duration/prolonged exposure of the T128N/P129A/Q286R/M298Q FVIIa within the desired target range of 24-120 ng/ml, which is based on the target range of NovoSeven®.

Example 8

Effect of Subcutaneous Modified FVIIa on Spontaneous Bleeding in Hemophilia A Rats Male and female rats that were confirmed homozygotic for Factor VIII (FVIII) deficiency ("F8−/− rats") were used to study the effect of subcutaneously modified FVIIa polypeptides on spontaneous bleeding. These Hemophilia A (HA) rats exhibit spontaneous bleeding comparable to what is seen in HA dogs and humans.

Figure 16B:
FIGS. 16A-16B depict a rat showing a typical presentation of a spontaneous bleed, and the rat of FIG. 16A 24 hours after the first dose of subcutaneous administration of a modified FVIIa, respectively.
Figure 16A:

F8−/− rats were treated upon detection of a bleed, which could include internal bleeds, or observable bleeds. FIG. 16A depicts a rat showing a typical presentation of a spontaneous bleed, which is an internal bleed, on the left hind foot. Upon detection of such a bleed, the rats were subcutaneously administered one dose of the T128N/P129A/Q286R/M298Q FVIIa at a dosage of 385 µg/kg. If needed, the dosage was repeated 2-3 times, with approximately 4-6 hours between each dose. FIG. 16B depicts the rat of FIG. 16A, 24 hours after the first dose of subcutaneous T128N/P129A/Q286R/M298Q FVIIa, showing a visible decrease in the swelling of the left hind foot, as compared with the swelling shown by the spontaneous bleed depicted in FIG. 16A. The rat depicted in FIG. 16B received two doses of the T128N/P129A/Q286R/M298Q FVIIa. A summary of the dosing regimens used in two groups of rats is summarized in Table 11 below.

TABLE 11

Dosing regimens for subcutaneous administration in hemophilia A rats

| Group | Dose | Vol | Route | $1^{st}$ dose | $2^{nd}$ dose | $3^{rd}$ dose | $4^{th}$ dose | $5^{th}$ dose |
|---|---|---|---|---|---|---|---|---|
| A | 0 ug/kg (Veh) | 1 mL/kg | SC | 0 hrs | 2.5 ± 0.5 hrs | ~2 hrs | 24 ± 2 hrs | 24 ± 4 hrs |
| B | 385 µg/kg | 1 mL/kg | SC | 0 hrs | 2.5 ± 0.5 hrs | ~2 hrs | 24 ± 2 hrs | 48 ± 4 hrs |

Three rats were successfully treated, with no treatment failures in the study. A treatment success was defined as an efficacy rating of a bleed as "excellent" or "good" after 1 to 3 doses of the T128N/P129A/Q286R/M298Q FVIIa within 12 hours assessed at the 24-hour time point. A treatment failure was defined as an efficacy rating of a bleed as "fair" or "poor" after 3 consecutive doses of the T128N/P129A/Q286R/M298Q FVIIa within 12 hours assessed at the 24-hour time point. The efficacy ratings are as defined as follows:

Excellent: Definite or abrupt improvement in signs of bleeding at 24 hours (window of +2 hours) after the initial injection Good: Moderate improvement in signs of bleeding at 24 hours (window of +2 hours) after the initial injection, possibly requiring more than one injection Fair: Probable or slight improvement in signs of bleeding at 24 hours (window of +2 hours) after the initial injection, requiring more than one injection Poor: No improvement or worsening in signs of bleeding at 24 hours (window of +2 hours) after the initial injection, possibly requiring rescue therapy These results showed that the T128N/P129A/Q286R/M298Q FVIIa can be useful for subcutaneous administration in an on-demand treatment, for treatment of a bleed once it is detected. The T128N/P129A/Q286R/M298Q FVIIa can be administered subcutaneously at a dosage of 60 µg/kg every 3 to 6 hours for a maximum of 3 doses within 24 hours of the first dose. Follow up treatment can optionally be administered, up to once daily for the two following days as necessary. In F8−/− rats of approximately 250 grams, the allometrically scaled equivalent to 60 µg/kg in a 70 kg individual is 385 µg/kg. An equivalent or similar scaling be used for the subcutaneous administration of the T128N/P129A/Q286R/M298Q FVIIa for a human subject, for example.

Example 9

Evaluation of the Pharmacokinetics, Pharmacodynamics, and Safety of Ascending Doses of Subcutaneous Administration of Modified FVIIa Polypeptide in Adult Subjects with Hemophilia The pharmacokinetics, pharmacodynamics, and safety of ascending doses of subcutaneously (SQ) administered T128N/P129A/Q286R/M298Q FVIIa in adult subjects with hemophilia was evaluated. It was also evaluated whether a split dose (two different anatomic sites for injection) of the same dose would provide comparable pharmacokinetics to a single injection.

Figure 17A:
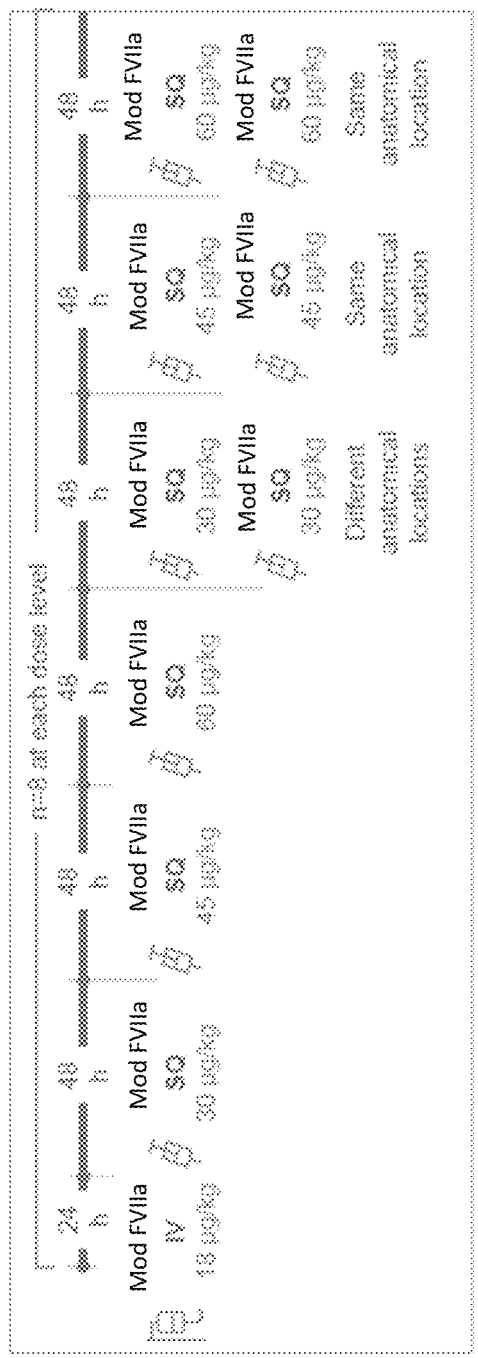
FIGS. 17A-17B are diagrams illustrating two exemplary variations of a study design for ascending subcutaneous doses of a modified FVIIa in humans having hemophilia.
Figure 17B:
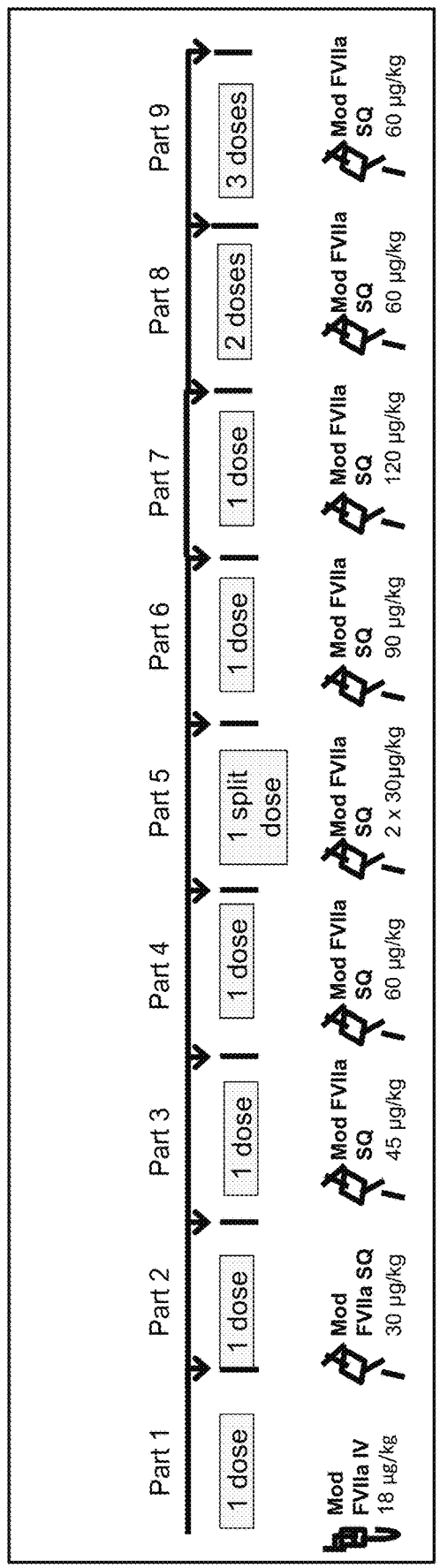

FIGS. 17A-17B are a diagrams illustrating two variations of a study design for ascending subcutaneous doses in humans having hemophilia. The modified FVIIa, T128N/P129A/Q286R/M298Q FVIIa, is denoted by "Mod FVIIa" in FIG. 17A. The T128N/P129A/Q286R/M298Q FVIIa was received by at least one subject in seven dosing stages or levels. At some levels, two subcutaneous administrations of the T128N/P129A/Q286R/M298Q FVIIa were performed at different anatomical locations. At some levels, two subcutaneous administrations of the T128N/P129A/Q286R/M298Q FVIIa were performed at the same anatomical location. The doses of T128N/P129A/Q286R/M298Q FVIIa used were 18, 30, 45, or 60 µg/kg, based on the weight of the subject. A single dose may require more than one injection.

The demographics of the eight subjects of the study are summarized in Table 12 below.

Figure 17C:
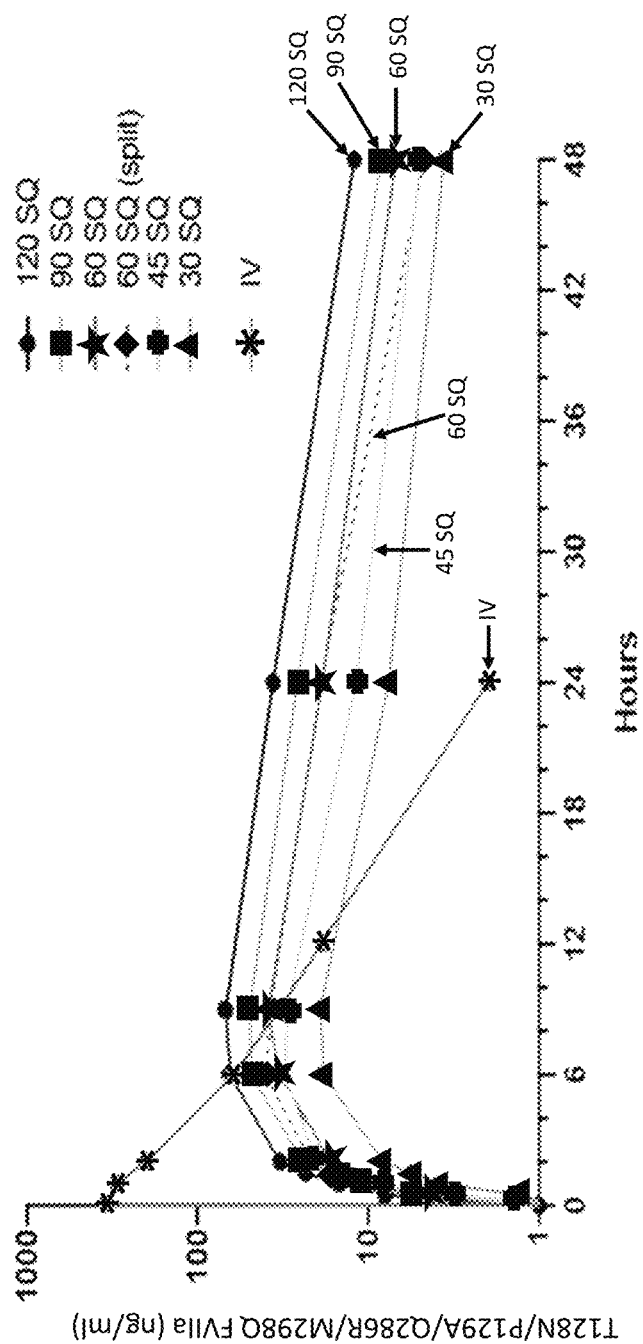
FIG. 17C is a graph depicting the mean pharmacokinetic levels of T128N/P129A/Q286R/M298Q FVIIa observed following ascending subcutaneous doses in humans having hemophilia.
Figure 17D:
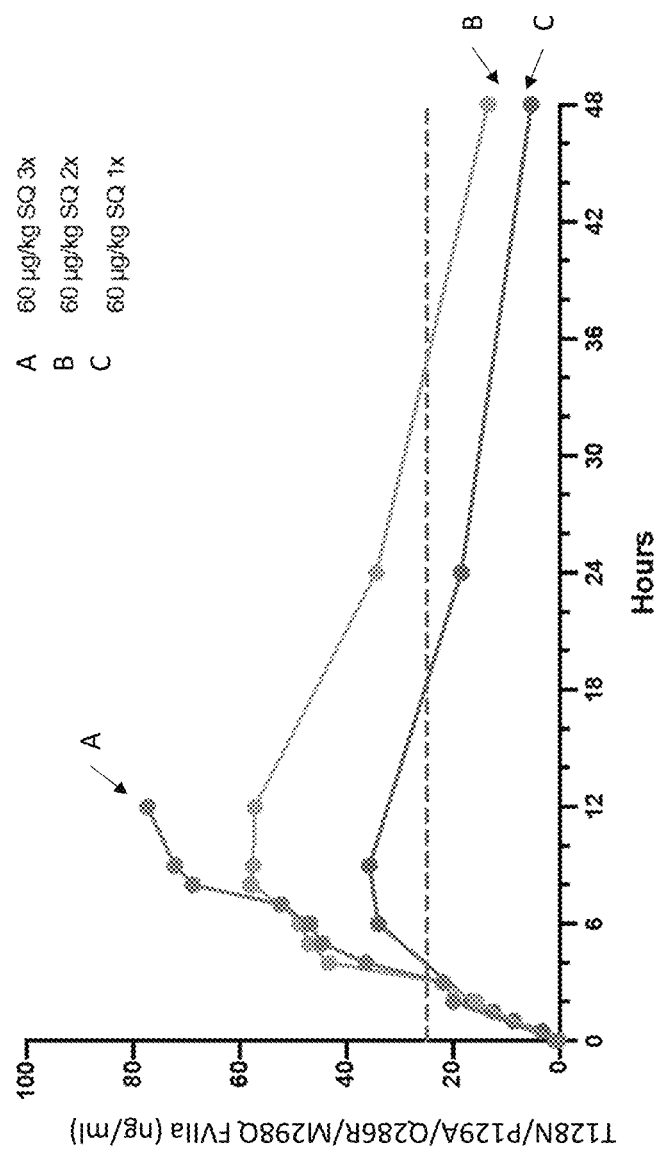
FIG. 17D is a graph depicting the results of a multiple subcutaneous dosing study in humans having hemophilia.

FIG. 17D is a graph depicting the results of a multiple dosing study of the subjects of the study design summarized

TABLE 12

Subject demographics of ascending subcutaneous dose study

| Subject | Age | Weight (kg) | Hemophilia Type | Hemophilia Severity | Factor Inhibitor Status | Ethnicity | Race |
|---|---|---|---|---|---|---|---|
| 1 | 47 | 114 | A | Severe | N | Not Hispanic or Latino | White |
| 2 | 35 | 90 | B | Severe | N | | |
| 3 | 35 | 65 | B | Moderate | N | | |
| 4 | 40 | 75 | A | Moderate | N | | |
| 5 | 46 | 70 | A | Severe | N | | |
| 6 | 38 | 30 | A | Severe | N | | |
| 7 | 20 | 69 | A | Moderate | N | | |
| 8 | 31 | 91 | A | Severe | Y | | |

After subcutaneous administration, the pharmacokinetic (PK) results demonstrated the following:

T128N/P129A/Q286R/M298Q FVIIa $T_{max}$, SQ=7.5 hours; IV=0.20 hours

SQ T128N/P129A/Q286R/M298Q FVIIa $C_{max}$=range 18.7 to 54.2 ng/ml

T128N/P129A/Q286R/M298Q FVIIa Mean Residence time, SQ=25.6 hours; IV=3.8 hours

FIG. 17C is a graph depicting the mean pharmacokinetic levels of T128N/P129A/Q286R/M298Q FVIIa observed in the study of ascending dosages. Standard PK parameters such as terminal half-life, area under the plasma concentration-time curve from time 0 to infinity (AUCO-t) and area under the plasma concentration-time curve from time 0 to the time of the last measurable plasma concentration (AUCO-inf), clearance, volume of distribution, mean residence time and bioavailability (of the subcutaneous administration) were calculated. A semi-parametric model described by Lee et al (Lee, 1990; Lee, 1997) was used to calculate the terminal half-life. A noncompartmental approach based on the trapezoidal rule was used to compute the area under curve (AUC) and the parameters derived from them. Descriptive statistics reported for each parameter include mean±standard deviation. All statistical tests were performed at the 0.05 significance level using two-sided tests, where appropriate.

The pharmacokinetic parameters observed are summarized in Table 13 below.

in FIGS. 17A-17B. The dotted line represents the target level of 24 ng/ml, based upon the effective levels of continuous infusion of NovoSeven® used for surgery. As an example, approximately 24-120 ng/ml is a target level of use of the T128N/P129A/Q286R/M298Q FVIIa. As shown in FIG. 17D, the subjects were able to maintain the target levels for approximately 18 hours with a single subcutaneous dose of 60 μg/kg (line C), and were able to maintain the target levels for over 24 hours when two or three doses were used (lines A and B).

These results demonstrate that the T128N/P129A/Q286R/M298Q FVIIa can be used in an ascending dose treatment regimen, and that the split dose showed a similar pharmacokinetic profile as a single dose. The T128N/P129A/Q286R/M298Q FVIIa can be used to achieve and maintain prolonged therapeutic levels, to allow treatment of acute bleeding events with subcutaneous injections in hemophilia A and B subjects with or without inhibitors. These results show a similar curve as the population PK simulations depicted in FIG. 15A.

Example 10

Evaluation of the Pharmacokinetics of Single Dose Subcutaneous Administration of Modified FVIIa Polypeptide in Normal Rats The pharmacokinetics of a single dose of subcutaneously (SQ) administered modified FVIIa polypeptides in normal

TABLE 13

Pharmacokinetic Parameters of Ascending Subcutaneous Administration
Route of Administration and Dose Level (Mean ± SD)

| PK Parameters | IV 18 μg/kg, n = 8 | SQ 30 μg/kg, n = 8 | SQ 45 μg/kg, n = 8 | SQ 60 μg/kg, n = 8 | SQ 60 μg/kg (split dose) n = 6 | SQ 90 μg/kg, n = 6 | SQ 120 μg/kg, n = 6 |
|---|---|---|---|---|---|---|---|
| $C_{max}$ (ng/mL) | 389 ± 100 | 18.7 ± 10.3 | 3.8 ± 18.9 | 38.8 ± 11.8 | 41.4 ± 18.0 | 50.1 ± 20.9 | 54.2 ± 20.9 |
| AUC 0-inf (ng/mL · hr) | 1375 ± 424 | 493 ± 171 | 864 ± 338 | 1081 ± 198 | 1030 ± 389 | 1483 ± 436 | 1787 ± 702 |
| AUC 0-t (ng/mL · hr) | 1368 ± 420 | 417 ± 179 | 707 ± 269 | 934 ± 209 | 968 ± 356 | 1185 ± 433 | 1302 ± 413 |
| $T_{1/2}$ (hr) | 3.4 ± 0.4 | | | | 17.0 ± 5.3 | | |
| $T_{max}$ (hr) | 0.20 ± 0.33 | | | | 7.5 ± 1.8 | | |
| MRT (hr) | 3.8 ± 0.43 | | | | 25.6 ± 7.1 | | |
| Vol. of dist. (mL/kg) | 54.6 ± 17.1 | | | | 1688 ± 764 | | |
| Clearance (mL/kg/hr) | 14.4 ± 4.9 | | | | 64.9 ± 21.4 | | | rats was evaluated. The T128N/P129A/Q286R/M298Q FVIIa and the Q286R/M298Q FVIIa polypeptide were evaluated.

Study Design

Normal male Sprague Dawley rats having an indwelling bilateral jugular vein cannula or single jugular vein cannula were used for the study. The T128N/P129A/Q286R/M298Q FVIIa polypeptide was provided in a stock concentration of 2.1 mg/ml (4.62 mg/vial added 2.2 ml sterile water for reconstitution). On the day of experiment, the test articles were thawed and diluted with buffer to 0.7 or 1.5 mg/ml. The buffer solution for dilution was prepared with the following: 10 mM L-Histidine, 29 mM sucrose, 390 mM glycine, 10 mM calcium chloride dihydrate, 3.35 mM L-Methionine, 0.03% Tween 80, pH 6.0.

The rats were divided into 4 groups of 3 animals each. Group 1 received 1.5 mg/kg the Q286R/M298Q FVIIa polypeptide in a dose volume of 1 mL/kg. Groups 2 and 3 received 0.27 or 1.5 mg/kg the T128N/P129A/Q286R/M298Q FVIIa polypeptide in a dose volume of 0.39 or 1 mL/kg, respectively. Group 4 received vehicle in a dose volume of 1 ml/kg. The test solutions were injected in the interscapular area of the neck.

In groups 1 to 3, blood samples were drawn at 0.083, 0.25, 0.5, 0.75, 1, 1.5, 2, 3, 4, 5, 6, and 12 hours post-dose. A terminal blood sample of 1500 µL was obtained via cardiac stick following CO2 inhalation at 24 hours. In group 4, blood samples were obtained pre-dose and at 24 hours post-dose. For sample processing, blood samples were collected into tubes containing 129 mM citrate stock solution (1 part citrate stock solution to 9 parts blood). When transferring the blood to citrate the two components were mixed by gently pipetting up and down 5 times. The samples were stored on wet ice until processed to plasma by centrifugation (4000×g for 5 minutes at 4° C. within 30 minutes of collection). The plasma samples were harvested and stored at −80° C. until analysis.

The plasma samples were then analyzed (Charles River) for test article content using STACLOT® VIIa-rTF Assay, a reagent kit from Diagnostica Stago, using a Start® 4 Coagulation Instrument with the software version 2.40. The coagulation time (seconds) was transformed in ng/mL using Power Fit on a log-log scale from the Microsoft Excel software.

Pharmacokinetic and Statistical Analysis

Drug concentration-time data were analyzed by non-compartmental methods with extravascular absorption using the add-in program PKSolver in Microsoft Excel 2.0 [1]. Three to five data points were automatically selected by the program for estimation of the terminal elimination half-life of the test articles. Differences between the T128N/P129A/Q286R/M298Q FVIIa and the Q286R/M298Q FVIIa polypeptides were analyzed by unpaired Student t-test without any correction for multiple comparisons. Results are presented as the mean and SD unless otherwise stated. Differences are shown as the mean and SE.

The relative bioavailability was calculated after log transformation of the area under curve (AUC) values. The difference was subsequently back transformed to obtain the AUC ratio between the T128N/P129A/Q286R/M298Q FVIIa and the Q286R/M298Q FVIIa polypeptides. The figures and statistical analyses were prepared in Graph Pad Prism 8.0.

Figures 18A, 18B:
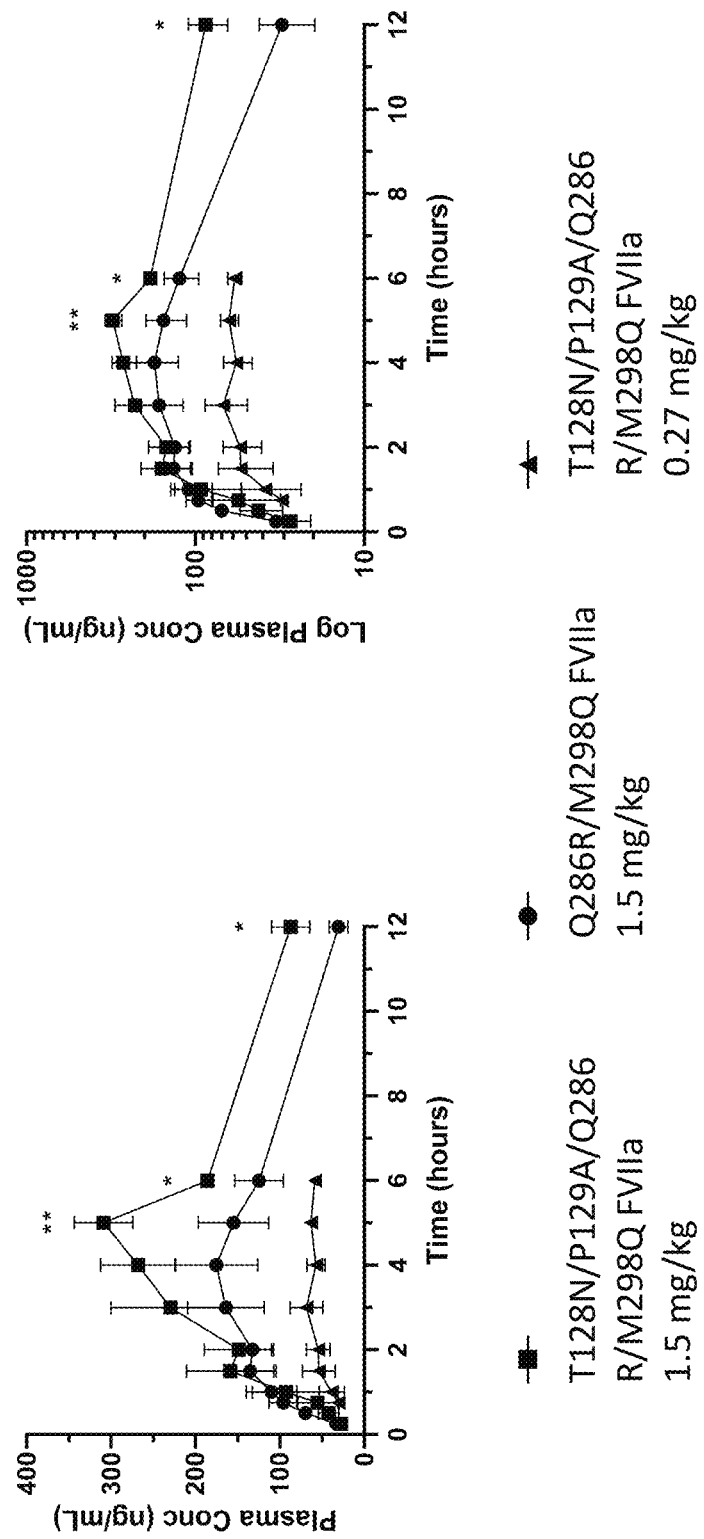
FIGS. 18A-18B depict the arithmetic and logarithmic plasma concentrations, respectively, of T128N/P129A/Q286R/M298Q FVIIa and Q286R/M298Q FVIIa polypeptides measured in plasma following a single dose of each of a subcutaneous administration to normal rats.

FIGS. 18A-18B depict the arithmetic and logarithmic plasma concentrations, respectively, of the T128N/P129A/Q286R/M298Q FVIIa and the Q286R/M298Q FVIIa polypeptides measured in plasma following a single dose of a subcutaneous administration to normal rats. These figures depict the results of Groups 1, 2, and 3 as described above. Until 2 hours post-dose, the plasma concentrations of the T128N/P129A/Q286R/M298Q FVIIa and the Q286R/M298Q FVIIa polypeptides at 1.5 mg/kg were superimposable, after which they deviated, with T128N/P129A/Q286R/M298Q FVIIa showing the highest plasma concentrations. The peak plasma concentrations, $C_{max}$, appeared 5 and 4 hours post-dose, being 309.1±34.9 and 179.0±50.3 ng/mL for T128N/P129A/Q286R/M298Q FVIIa and Q286R/M298Q FVIIa, respectively, the difference being 130.0±35.4 ng/mL (P<0.02). At the low dose of T128N/P129A/Q286R/M298Q FVIIa, there was a lag time of about 0.5 to 1 hour before T128N/P129A/Q286R/M298Q FVIIa could be detected in plasma with a mean Cmax of 68.7±19.3 ng/mL at 3 hours. The difference in Cmax between the high and low dose of T128N/P129A/Q286R/M298Q FVIIa appeared dose-proportional.

The apparent half-life ($T^{1/2}$) was estimated to 4.3±0.8 h and 3.0±0.4 h for T128N/P129A/Q286R/M298Q FVIIa and Q286R/M298Q FVIIa, respectively, the difference being 1.3±0.5 h (P=0.06).

The estimated pharmacokinetic parameters and the raw data are shown in Tables 14A and 14B, respectively. PK parameters for the low dose of T128N/P129A/Q286R/M298Q FVIIa were not estimated due to flat plasma concentration-time profiles measured in two rats and steadily increasing plasma concentrations in one rat.

T128N/P129A/Q286R/M298Q FVIIa molecules stayed longer in the body with a the mean residence time (MRT) of 8.2±0.89 h when compared with 5.8±0.47 h for Q286R/M298Q FVIIa, the difference being 2.4±0.58 h (P<0.02).

The relative bioavailabilty of T128N/P129A/Q286R/M298Q FVIIa when compared to Q286R/M298Q FVIIa (AUC(T128N/P129A/Q286R/M298Q FVIIa)/AUC (Q286R/M298Q FVIIa)) was estimated to 1.80 (1.04-3.13, 95% C.I., P<0.05).

It appears from FIGS. 18A-18B that the plasma concentration-time profile of T128N/P129A/Q286R/M298Q FVIIa was not as smooth as Q286R/M298Q FVIIa showing an unexpected drop in the plasma concentration at 6 h post-dose. Therefore, the standard deviation for $T^{1/2}$ was 2-fold higher with T128N/P129A/Q286R/M298Q FVIIa and the difference in $T^{1/2}$ only reached border-line significance. It should be noticed also that only 3 animals were included in each treatment group.

These results showed that the T128N/P129A/Q286R/M298Q FVIIa polypeptide demonstrated an apparent half-life of about 4 hours after subcutaneous injection to Sprague Dawley male rats. The systemic exposure of T128N/P129A/Q286R/M298Q FVIIa was dose-proportional at the doses administered. When compared to Q286R/M298Q FVIIa, which lacks the additional N-glycosylation site introduced by the two specific substitutions T128N and P129A of the T128N/P129A/Q286R/M298Q FVIIa polypeptide, the T128N/P129A/Q286R/M298Q FVIIa polypeptide showed approximately a 2-fold higher bioavailability after a single subcutaneous injection in the normal rats.

TABLE 14A

Estimated Pharmacokinetic Parameters of Subcutaneous Injection

T128N/P129A/Q286R/M298Q FVIIa at 1.5 mg/kg

| Parameter | | Rat 4 | Rat 5 | Rat 6 | Mean | SD |
|---|---|---|---|---|---|---|
| Ke | 1/h | 0.1964 | 0.1610 | 0.1357 | 0.1644 | 0.0305 |
| t1/2 | h | 3.5293 | 4.3065 | 5.1074 | 4.3144 | 0.7891 |
| Tmax | h | 5 | 5 | 5 | 5 | 0 |
| Cmax | ng/ml | 294.9 | 283.5 | 348.8 | 309.1 | 34.88 |
| Clast_obs/Cmax | | 0.2278 | 0.2927 | 0.3214 | 0.2806 | 0.0480 |
| AUC 0-t | ng/ml*h | 1771.0 | 1844.1 | 2315.3 | 1976.8 | 295.4 |
| AUC 0-inf_obs | ng/ml*h | 2113.0 | 2359.6 | 3141.3 | 2538.0 | 536.9 |
| AUC 0-t/0-inf_obs | | 0.8381 | 0.7815 | 0.7371 | 0.7856 | 0.0507 |
| AUMC 0-inf_obs | ng/ml*h^2 | 15396.2 | 19646.9 | 28455.2 | 21166.1 | 6660.7 |
| MRT 0-inf_obs | h | 7.2864 | 8.3265 | 9.0584 | 8.2238 | 0.8904 |

Q286R/M298Q FVIIa at 1.5 mg/kg

| Parameter | | Rat 1 | Rat 2 | Rat 3 | Mean | SD |
|---|---|---|---|---|---|---|
| Ke | 1/h | 0.2594 | 0.2430 | 0.2008 | 0.2344 | 0.0302 |
| t1/2 | h | 2.6718 | 2.8529 | 3.4522 | 2.9923 | 0.4084 |
| Tmax | h | 4 | 4 | 3 | 3.7 | 0.58 |
| Cmax | ng/ml | 219.2 | 122.6 | 195.3 | 179.0333 | 50.31 |
| Clast_obs/Cmax | | 0.1361 | 0.1653 | 0.2180 | 0.1731 | 0.0415 |
| AUC 0-t | ng/ml*h | 1439.2 | 928.6 | 1480.9 | 1282.9 | 307.5 |
| AUC 0-inf_obs | ng/ml*h | 1554.2 | 1012.1 | 1692.9 | 1419.7 | 359.8 |
| AUC 0-t/0-inf_obs | | 0.9260 | 0.9176 | 0.8748 | 0.9061 | 0.0275 |
| AUMC 0-inf_obs | ng/ml*h^2 | 8568.8 | 5657.1 | 10765.6 | 8330.5 | 2562.6 |
| MRT 0-inf_obs | h | 5.5133 | 5.5896 | 6.3592 | 5.8207 | 0.4679 |

TABLE 14B

Raw Data of Single Subcutaneous Dose in Rats Study

| Time | CB813a 1.5 mg/kg | | | T128N/P129A/Q286R/ M298Q 1.5 mg/kg | | | T128N/P129A/Q286R/ M298Q 0.27 mg/kg | | |
|---|---|---|---|---|---|---|---|---|---|
| (hours) | Rat 1 | Rat 2 | Rat 3 | Rat 4 | Rat 5 | Rat 6 | Rat 7 | Rat 8 | Rat 9 |
| 0.083 | | | | | | | | | |
| 0.25 | 35.22 | 30.06 | 34.94 | 32.16 | BLQ | 22.78 | BLQ | BLQ | BLQ |
| 0.5 | 69.84 | 69.08 | 71.42 | 48.89 | 28.61 | 50.05 | BLQ | BLQ | BLQ |
| 0.75 | 105.0 | 76.45 | 107.4 | 53.79 | 32.44 | 81.07 | 30.85 | BLQ | BLQ |
| 1 | 110.0 | 80.15 | 140.7 | 68.94 | 71.77 | 139.1 | 55.37 | 34.50 | 26.33 |
| 1.5 | 150.2 | 100.2 | 156.1 | 134.7 | 123.8 | 218.6 | 74.23 | 52.26 | 35.69 |
| 2 | 139.7 | 107.2 | 151.2 | 133.7 | 117.4 | 195.3 | 67.55 | 56.82 | 39.75 |
| 3 | 185.0 | 111.9 | 195.3 | 169.4 | 213.0 | 307.3 | 79.04 | 80.71 | 46.46 |
| 4 | 219.2 | 122.6 | 185.0 | 231.9 | 255.1 | 317.8 | 45.49 | 67.10 | 59.46 |
| 5 | 185.4 | 107.4 | 172.3 | 294.9 | 283.5 | 348.8 | 62.69 | 71.57 | 56.21 |
| 6 | 139.0 | 91.85 | 143.7 | 184.6 | 185.1 | 188.2 | 52.25 | 62.09 | 62.18 |
| 12 | 29.83 | 20.27 | 42.57 | 67.17 | 82.97 | 112.1 | BLQ | BLQ | BLQ |

BLQ: Below Limit of Quantification

Example 11

On-Demand Treatment Using Modified FVIIa Polypeptide in Hemophilic Dogs

Hemophilic dogs, which exhibit spontaneous bleeding, were used to evaluate on-demand subcutaneous (SQ) administration of the modified FVIIa polypeptide, T128N/P129A/Q286R/M298Q FVIIa polypeptide.

Study Design

The T128N/P129A/Q286R/M298Q FVIIa polypeptide was provided in vials of 4.6 mg and reconstituted with 2.2 mL of sterile water resulting in a final concentration of 2100 μg/mL after reconstitution.

Hemophilic dogs were included in the study when diagnosed with clinical signs of bleeding, and received a SQ administration of the T128N/P129A/Q286R/M298Q FVIIa polypeptide in a dose of a maximum of 120 μg/kg. If the bleeding did not stop within three hours, by exhibiting a continuous drop of hematocrit (HCT) in repeated measurements, or showing persistent clinical signs of ongoing bleeding, the T128N/P129A/Q286R/M298Q FVIIa polypeptide was re-dosed. The re-dosing was performed up to a total of three doses a day for a maximum of five days. Blood samples for kaolin thromboelastography (kaolin-TEG) were taken from the hemophilic dogs throughout the treatment.

Thromboelastography

Thromboelastography (TEG) was used to reflect the coagulation potential in hemophilia after administration of rFVIIa previously, and here was used for the evaluation of the T128N/P129A/Q286R/M298Q FVIIa polypeptide administration to hemophilic dogs. The TEG analyses were performed with a blood sample, wherein the first 3 mL of blood was discarded, and then 1 mL of blood was drawn and mixed with kaolin (Haemoscope). A 360 µL aliquot of pre-mixed blood/initiator was placed into a measurement instrument (Haemoscope TEG 5000 Thromboelastograph Analyzer) and analyzed. TEG recordings were allowed to proceed for approximately 60 to 90 minutes. Blood was drawn at each selected sampling point and tested within 2 minutes after collection using the instrument.

Results

Five dogs were included in the study and treated individually according to the protocol. Three dogs presented with rear leg hematomas, one dog presented with bleeding on the right foreleg, and one dog presented with a hematoma on the left side of its thorax. Individual summary tables are shown in Tables 15-1 to 15-5 below.

Figure 19B:
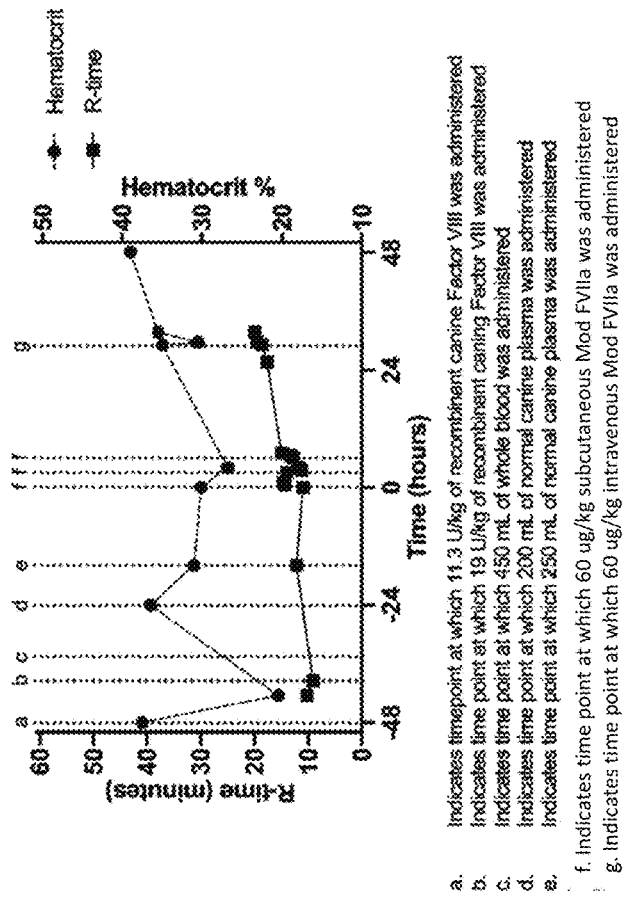
FIGS. 19A-19E depict the thromboelastograph (TEG) profiles and hematocrit measured from five hemophilic dogs treated with a T128N/P129A/Q286R/M298Q FVIIa polypeptide.
Figure 19A:
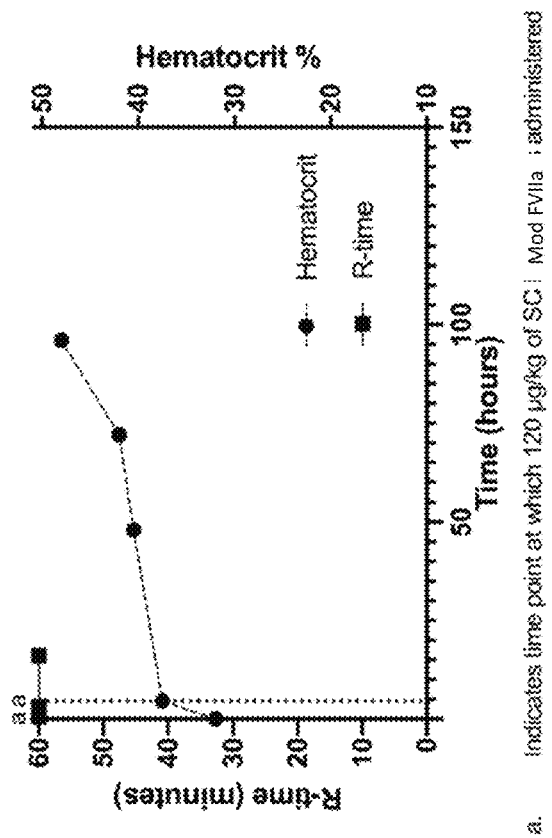
Figure 19D:
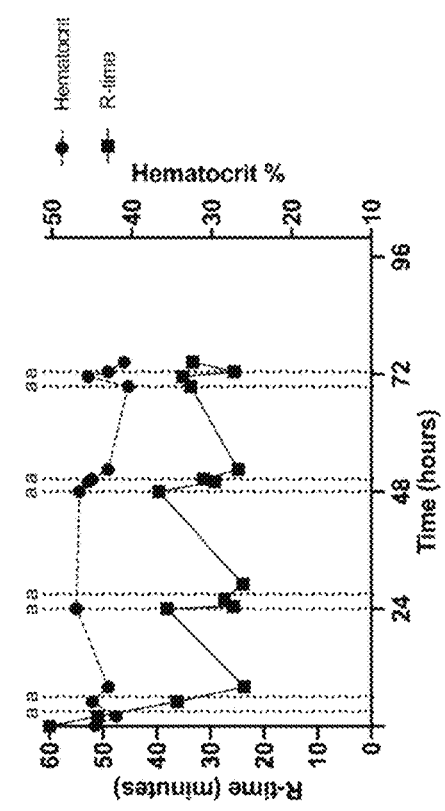

Dog W03 had a left rear leg hematoma (non-weight-bearing). He was treated twice with 120 µg/kg of SQ administered T128N/P129A/Q286R/M298Q FVIIa polypeptide. Each dose was 4.5 hours apart. Hematocrit rapidly increased, stabilized, and the following day, the dog was bearing some weight on the affected leg, with swelling slightly reduced and firm. No further treatment was indicated. Over the next two days the swelling gradually decreased, and the leg was fully weight-bearing, and the dog was active. TEG results were unaffected by the treatment, and all R-values were determined to be more than 60 minutes. A summary of the dog W03 data is in Table 15-1 below, and FIG. 19A depicts the TEG profile and hematocrit of dog W03. FIGS. 20A-20E depict TEG traces measured from dog W03 at various time points after SQ treatment.

Dog R11 presented with a large hematoma on the left side of the thorax. Two days before the study, recombinant canine FVIII (rcFVIII) at a dose of 11.3U/kg was administered. Despite receiving this treatment, HCT dropped from 37.5% to 20.5%. 19 U/kg of rcFVIII was further administered, as well as 450 mL of whole blood (WB). The following day, HCT was 36.5%, the hematoma was firm with drainage from the chest into the inguinal area, and 200 mL normal canine plasma (NCP) was administered. Eight hours later, HCT had decreased to 31% and 250 mL of NCP was further administered.

After failure to respond sufficiently to the rcFVIII and WB infusions, three doses of the T128N/P129A/Q286R/M298Q FVIIa polypeptide were administered SQ at a dose of 60 µg/kg, three hours apart, and with a final dose of 60 µg/kg administered IV the following day in response to an erroneously low hematocrit. Hematocrit was measured at 35% after 24 hours and the bleeding was assessed as being resolved. No TEG was determined before initiation of rcFVIII treatment. Post-treatment TEG reflected a low R-time of 10.2 minutes, and only minor changes were observed after the treatments. A summary of the dog R11 data is in Table 15-2 below, and FIG. 19B depicts the TEG profile and hematocrit of dog W03. FIGS. 21A-21M depict TEG traces measured from dog R11 at various time points before and after SQ treatment, and before and after IV treatment on the second day. The T128N/P129A/Q286R/M298Q FVIIa polypeptide is also referred to as "Mod FVIIa" in the figures.

TABLE 15-1

Dog W03 Summary Table

FVIII-, Male     DOB: 16Jan2018

| W03 Date | Time (actual) | Time (hrs) | Dose (µg/kg) | Events | HCT 37 to 55% | TEG R (minutes) |
|---|---|---|---|---|---|---|
| 20Mar2019 | 12:11 pm | 0 | 120 | LR leg hematoma (non-weight-bearing); Pretreatment samples obtained; injected 1.2 mL SC between scapula. No localized reaction noticed. | 32 | |
| | 12:41 pm | | 0.5 | TEG 30 minutes post | | 131, 6 |
| | 1:11 pm | 1 | | TEG 60 minutes post | | 139, 7 |
| | 2:11 pm | 2 | | TEG 120 minutes post | | 125, 8 |
| | 3:11 pm | 3 | | TEG 160 minutes post | | 106 |
| | 4:45p | 4.5 | 120 | Injected 1.2 mL Sc, no reaction | | |
| 21Mar2019 | | 16 | | BAR, bearing some weight, swelling slightly reduced and firm ~16 hours post injection TEG | 37, 5 | 86, 3 |
| 22Mar2019 | | 48 | | Bearing weight on LR but occasionally holding up | 40, 5 | |
| 23Mar2019 | | 72 | | Still min or swelling in LR, BAR, very active | 42 | |
| 24Mar2019 | | 96 | | Full weight bearing, no lameness, swelling decreased, BAR, very active | 48 | |

Abbreviations: BAR = Bright, Alert and Responsive;
FVIII- = Factor VIII deficient;
HCT = hematocrit;
LR = left rear;
SC = subcutaneous;
TEG = thromboelastography.

TABLE 15-2

Dog R11 Summary Table

| R11 | | | | FVIII-, Female | | DOB: 02Sep2013 |
|---|---|---|---|---|---|---|
| Date | Time (actual) | Time (hrs) | Dose (µg/kg) | Events | HCT 37 to 55% | TEG R (minutes) |
| 09Sep2019 | AM | | | Large hematoma on left side Given rFVIII at 11.3 U/kg Pre TEG | 37.5 | |
| | | | | Post TEG | | 10.2 |
| | 1:30 pm | | | Depressed drop in HCT | 20.5 | |
| | 4:30 pm | | | 450 mL WB, rFVIII at 19 U/kg, 10 minutes post TEG | | 9.1 |
| 01Oct2019 | AM | | | BAR, hematoma firm with drainage from chest to inguinal area Treated with 200 mL normal canine plasma | 36.5 | |
| | PM | | | Continued improvement, treated with 250 mL normal canine plasma 10 minutes post TEG | 31 | 12.5 |
| 02Oct2019 | 8:40 am | 0 | 60 (SC) | SC injection for Large hematoma on Left side with significant drainage into chest, pre samples/pre TEG at 8:38 am | 30.1 L | 11 |
| | 9:10 am | 0.5 | | 30 minutes post sample | | 14, 4 |
| | 9:40 am | 1 | | 1 hour post sample | | 14, 6 |
| | 11:36 am | 3 | | 3 hour post sample | | 14 |
| | 11:40 am | 3 | 60 (SC) | 2nd SC injection | | |
| | 12:12 pm | 3.5 | | 30 minutes post sample | | 11, 2 |
| | 12:43 pm | 4 | | 1 hour post sample | 26.8 L | 11, 6 |
| | 2:42 pm | 6 | | 3 hours post sample, 3rd SC injection | | 12, 8 |
| | 3:12 pm | 6.5 | | 30 minutes post sample | | 13, 4 |
| | 3:42 pm | 7 | | 1 hour post sample | | 15 |
| 03Oct2019 | 1:25 pm | 25.75 | 60 (IV) | Pre samples, IV infusion | | 17, 7 |
| | 1:56 pm | 29.15 | | 30 minutes post sample | 35 | 18, 7 |
| | 2:25 pm | 29.75 | | 1 hour post sample | 30, 5 | 19, 6 |
| | 4:27 pm | 31.75 | | 3 hour post sample | 35, 5 | 20 |
| 04Oct2019 | | 48 | | no treatment | 39 | |

Abbreviations: FVIII- = Factor VIII deficient;
HCT = hematocrit;
SC = subcutaneous;
TEG = thromboelastography;
WB = whole blood.

Dog R04 had a right rear leg hematoma, but continued to bear weight. Hematocrit was unaffected and remained stable, at around 40% during the four days of observation. Three doses of the T128N/P129A/Q286R/M298Q FVIIa polypeptide were administered three hours apart on Day 1. On Day 2, the size of the hematoma had decreased, and two doses were injected six hours apart. Finally, two doses were administered on Day 3, each five hours apart. The hematoma was observed to be almost resolved with significant drainage into the hock. All treatments were 120 µg/kg of the T128N/P129A/Q286R/M298Q FVIIa polypeptide, dosed subcutaneously. Bleeding was considered to be resolved on Day 4, and the drainage had decreased and the leg was fully weight bearing. These results are summarized in Table 15-3 below.

Figure 19C:
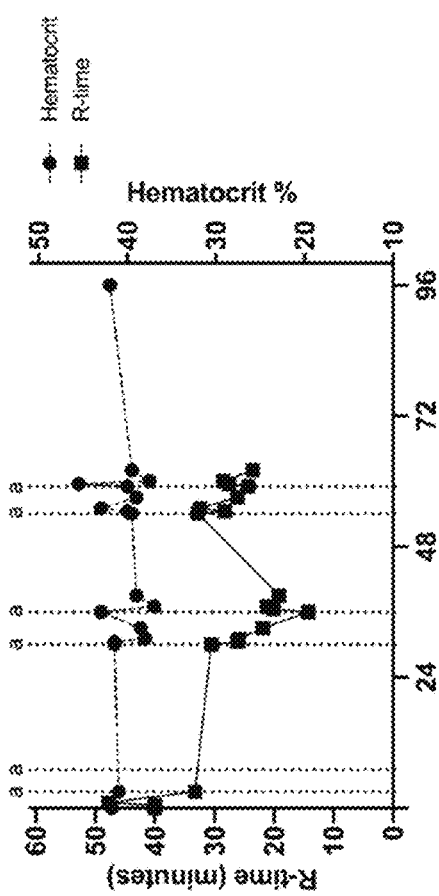

TEG analysis was conducted in relation to treatment. From a baseline R-value of 40 minutes, the R-time declined as a response to treatment with the T128N/P129A/Q286R/M298Q FVIIa polypeptide, from 33 minutes on Day 1, to Day 2 where the R-time corrected to a low of 14 minutes. R-time increased to 32 minutes on Day 3 before treatment, then dropped to 24 minutes. TEG profile and hematocrit of Dog R04 are depicted in FIG. 19C, and the TEG traces are depicted in FIGS. 22A-22T. The TEG traces are of before and after SQ administration of the T128N/P129A/Q286R/M298Q FVIIa polypeptide.

TABLE 15-3

Dog R04 Summary Table

| R04 | | | | FVIII-, Female | | DOB: 2Aug2013 |
|---|---|---|---|---|---|---|
| Date | Time (actual) | Time (hrs) | Dose (µg/kg) | Events | HCT 37 to 55% | TEG R (minutes) |
| 08Oct2019 | 3:30 pm | 0 | 120 (SC) | SC injection for right rear leg hematoma, pre samples/pre TEG 3:29 pm | 41, 8 | 40, 1 |

TABLE 15-3-continued

Dog R04 Summary Table

R04     FVIII-, Female     DOB: 2Aug2013

| Date | Time (actual) | Time (hrs) | Dose (μg/kg) | Events | HCT 37 to 55% | TEG R (minutes) |
|---|---|---|---|---|---|---|
| | 4:00 pm | 0.5 | | 30 minutes post sample | | 40 |
| | 4:30 pm | 1 | | 1 hour post sample | | 47, 9 |
| | 5:00 pm | 3 | | 1.5 hour post sample | 41 | 33, 3 |
| | 5:05 pm | 3 | 120 (SC) | 2nd SC injection, no follow-up samples | | |
| | 9:00 pm | 7 | 120 (SC) | Dog continues to bear weight 3rd SC injection, no follow-up samples | | |
| 09Oct2019 | 7:55 am | 30 | 120 (SC) | Hematoma decreased in size, weight bearing × 4 4th SC injection with pre samples | 41, 5 | 30, 6 |
| | 8:25 am | 30.5 | | 30 minutes post sample | 41, 5 | 26, 2 |
| | 8:55 am | 31 | | 1 hour post sample | 38 | 26 |
| | 10:55 am | 33 | | 3 hour post sample | 38, 5 | 21, 9 |
| | 2:04 pm | 36 | 120 (SC) | 5th SC injection, pre samples | 43 | 14, 3 |
| | 2:35 pm | 36.5 | | 30 minutes post sample | | 20, 1 |
| | 3:08 pm | 37 | | 1-hour post sample | 37 | 21, 2 |
| | 5:02 pm | 39 | | 3-hour post sample | 39 | 19, 2 |
| 10Oct2019 | 7:55 am | 54 | 120 (SC) | Hematoma mostly resolved, significant drainage into hock, very BAR, weight bearing × 4 6th SC injection with pre samples | 39, 5 | 32, 8 |
| | 8:28 am | 54.5 | | 30 minutes post sample | 40 | 28, 3 |
| | 8:58 am | 55 | | 1-hour post sample | 43 | 32, 5 |
| | 11:02 am | 57 | | 3 hour post sample | 39 | 26, 2 |
| | 1:00 pm | 59 | 120 (SC) | 7th SC injection | 40 | 24, 6 |
| | 1:32 pm | 59.5 | | 30 minutes post sample | 45, 5 | 27, 6 |
| | 2:02 pm | 60 | | 1 hour post sample | 37, 5 | 28, 6 |
| | 4:01 pm | 62 | | 3 hour post sample | 39, 5 | 23, 6 |
| 11Oct2019 | | 96 | | Drainage decreased, fully weight bearing no treatment | 42 | |
| 12Oct2019 | | | | BAR, little to no swelling in right rear leg | 47.5 | |

Abbreviations: BAR = Bright, Alert and Responsive;
FVIII- = Factor VIII deficient;
HCT = hematocrit;
SC = subcutaneous;
TEG = thromboelastography.

Dog W64 presented with a right rear leg hematoma, which had been non-weight-bearing for three days with no improvement after isolation. Hematocrit remained 40-47% in the normal range within the observation period. The T128N/P129A/Q286R/M298Q FVIIa polypeptide was administered SQ at a dose of 120 μg/kg three times on Day 1, and two times on Days 2, 3, and 4. On individual days, the doses were administered with three hour intervals. Two days after the first treatment of the T128N/P129A/Q286R/M298Q FVIIa polypeptide, the dog started to bear some weight on the right foreleg, and then gradually improved over the following two days. Bleeding was considered to be resolved on Day 4. These results are summarized in Table 15-4 below.

TEG analysis was conducted on all four days in relation to treatment, and a clear response to T128N/P129A/Q286R/M298Q FVIIa polypeptide treatment was observed. From a baseline R-value of over 60 minutes, the R-time declined as a response to the treatment with T128N/P129A/Q286R/M298Q FVIIa polypeptide, on Day 1 to 23 minutes. On Day 2, the pre-administration R-time was 38 minutes, then dropped to as low as 24 minutes; an increased was observed on Day 3 to 39 minutes and again fell to 24 minutes. On Day 4, before treatment, the R-time was 33 minutes, then dropped to 25 minutes after treatment. FIG. 19C depicts the TEG profile and hematocrit of dog W03, and TEG traces of Dog W64 are depicted in FIGS. 23A-23P. The TEG traces are of before and after SQ administration of the T128N/P129A/Q286R/M298Q FVIIa polypeptide.

TABLE 15-4

Dog W64 Summary Table

| | | | | | | |
|---|---|---|---|---|---|---|
| | W64 | | | FVIII-, Male | | DOB: 12/27/18 |
| Date | Time (actual) | Time (hrs) | Dose (µg/kg) | Events | HCT 37 to 55% | TEG R (minutes) |
| 17Oct2019 | 9:16 am | 0 | 120 (SC) | Non-weight-bearing for 3 days on right rear leg with no improvement after isolation, pre samples/pre TEG 9:15 am, 1st SC injection | 44, 7 | >60.0 |
| | 11:15 am | 2 | | 2 hour post sample | 42 | 51 |
| | 12:15 pm | 3 | 120 (SC) | 2nd SC injection | | |
| | 2:15 pm | 5 | | 2 hour post sample | 45 | 36, 2 |
| | 3:05 pm | 6 | 120 (SC) | 3rd SC injection | | |
| | 5 pm | 8 | | 2 hour post sample | 43 | 23, 7 |
| 18Oct2019 | 9 am | 24 | 120 (SC) | Still non-weight-bearing on right rear Pre samples/pre TEG, 4th SC injection | 47 | 38, 1 |
| | 9:30 am | 24.5 | | 30 minutes post TEG | | 25, 8 |
| | 11 am | 26 | | 2 hour post sample | | 27, 4 |
| | 12:15 pm | 27 | 120 (SC) | 5th SC injection | | |
| | 2:15 pm | 29 | | 2 hour post sample | | 24 |
| 19Oct2019 | 9:30 am | 48 | 120 (SC) | BAR, bearing some weight on right rear Pre samples/pre TEG, 6th SC injection | 46, 6 | 39, 6 |
| | 11:28 am | 50 | | 2 hour post sample | 45, 5 | 29, 2 |
| | 12:52 pm | 50.5 | 120 (SC) | pre TEG, 7th SC injection | 45 | 31, 3 |
| | 2:53 pm | 52.5 | | 2 hours post sample | 43 | 24, 9 |
| 20Oct2019 | 8:55 am | 69.5 | 120 (SC) | BAR, bearing more weight on right rear, acting like normal self Pre samples/pre TEG, 8th SC injection | 40, 5 | 33, 7 |
| | 11:04 am | 71.5 | | 2 hr post sample | 45, 5 | 35, 2 |
| | 12:20 pm | 72.5 | 120 (SC) | pre TEG, 9th SC injection | 43 | 25, 6 |
| | 2:20 pm | 74.5 | | 2 hour post sample | 41 | 33, 3 |
| 21Oct2019 | | | | Continues to bear weight no treatment | n/a | |

Abbreviations: BAR = Bright, Alert and Responsive;
FVIII- = Factor VIII deficient;
HCT = hematocrit;
na = not applicable;
SC = subcutaneous;
TEG = thromboelastography.

Figure 19E:
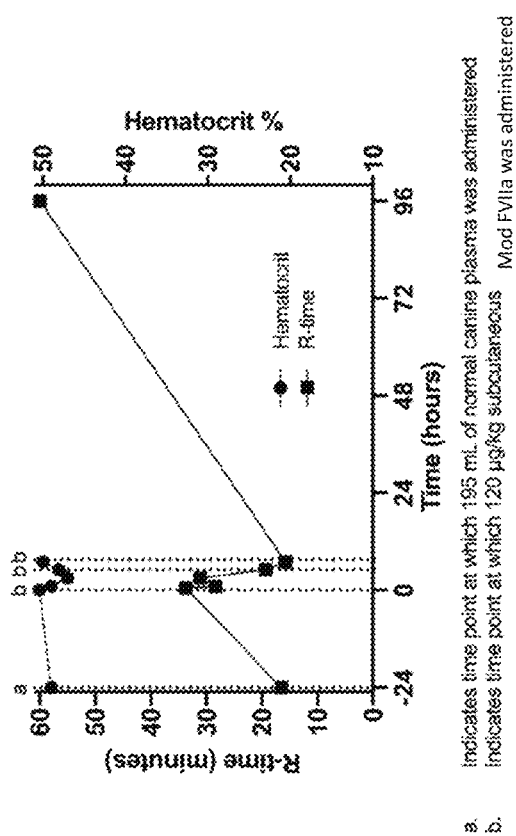

Dog V30 presented with bleeding in the right foreleg, and was initially treated with 195 mL NCP. The day after, the dog continued to present with non-weight-bearing lameness of the right foreleg, and three SQ injections of the T128N/P129A/Q286R/M298Q FVIIa polypeptide at a dose of 120 µg/kg were administered per protocol intervals. Afterwards, the dog started to use the leg, and bleeding was considered to be resolved. A 60% HCT was determined on diagnosis and no further analysis was performed, as the dog was considered to be recovered. These data are summarized in Table 15-5 below. No pre-dose TEG was performed, but the baseline R-time was determined to be over 60 minutes, 4 days after the bleeding event. A clear response to the T128N/P129A/Q286R/M298Q FVIIa polypeptide administration was observed on the R-time being 33 minutes half an hour after the first injection, then declining to a minimum of 15 minutes after three injections, which reverted to baseline at a follow-up off treatment. FIG. 19E depicts the TEG profile and hematocrit of dog V30. FIGS. 24A-24F depict TEG traces of after SQ administration of dog V30, and a trace of a reversion to the untreated baseline.

TABLE 15-5

Dog V30 Summary Table

| | | | | | | |
|---|---|---|---|---|---|---|
| | V30 | | | FVIII-, Female | | DOB: 8/30/17 |
| Date | Time (actual) | Time (hrs) | Dose (µg/kg) | Events | HCT 37 to 55% | TEG R (minutes) |
| 26Feb2019 | | | | Non-weight-bearing on right foreleg Treated with 195 mL NCP 10 minutes post TEG | 49 | 16.5 |

TABLE 15-5-continued

Dog V30 Summary Table

| V30 | | | | FVIII-, Female | | DOB: 8/30/17 |
|---|---|---|---|---|---|---|
| Date | Time (actual) | Time (hrs) | Dose (μg/kg) | Events | HCT 37 to 55% | TEG R (minutes) |
| 27Feb-20 | 9:11 am | 0 | 120 (SC) | Continues to be Non-weight-bearing Right Foreleg | | 50, 4 |
| | 9:41 am | 0.5 | | 30 minutes post TEG | | 33, 8 |
| | 10:11 am | 1 | | 1 hour post 1EG | 49 | 28, 4 |
| | 12:13 pm | 3 | | 3 hour post 1EG | 47 | 31, 2 |
| | 2:09 pm | 5 | 120 (SC) | Still occasional lameness pre 2nd dose TEG | 48 | 19, 4 |
| | 4:01 pm | 7 | | pre 3rd dose TEG | 50 | 15, 8 |
| | 4:30 pm | 7.5 | | | 120 (SC) | |
| 03Mar2020 | | 96 | | | | >60.0 |

Abbreviations: FVIII- = Factor VIII deficient;
HCT = hematocrit;
NCP = normal canine plasma;
SC = subcutaneous;
TEG = thromboelastography.

As described above, the five hemophilic dogs with spontaneous bleeding were subcutaneously administered the T128N/P129A/Q286R/M298Q FVIIa polypeptide to control the bleeding. According to the protocol, the dogs were treated up to three times a day, with a dose of 120 μg/kg, at or longer than three hour intervals. The five dogs received 2 to 9 subcutaneous doses of the T128N/P129A/Q286R/M298Q FVIIa polypeptide during the 1 to 4 days.

The overall clinical response to the subcutaneous administration of the T128N/P129A/Q286R/M298Q FVIIa polypeptide was positive with a control of bleeding, and general improvement in the condition of the dogs. Thus, subcutaneous administration of T128N/P129A/Q286R/M298Q FVIIa polypeptide appears to be effective as an on-demand treatment of spontaneous bleeding in hemophilic dogs. The data presented support previous results demonstrating the hemostatic effect of the T128N/P129A/Q286R/M298Q FVIIa polypeptide in hemophilic mice, treated subcutaneously on-demand after tail injury (see Examples 1 and 2). The subcutaneous T128N/P129A/Q286R/M298Q FVIIa polypeptide administration was efficacious as a monotherapy, and led to the resolution of clinical symptoms when administered to hemophilic dogs with spontaneous ongoing bleeding.

Example 12

Effect of Subcutaneous Administration of Modified FVIIa Polypeptide on Spontaneous Bleeding in Hemophilia A Rats As previously discussed (see Example 8), the subcutaneous (SQ or SC) administration of the T128N/P129A/Q286R/M298Q FVIIa polypeptide was evaluated for its use as an on-demand treatment of spontaneously occurring bleeding episodes in Hemophilia A (HA) rats, assessed 24 hours post initial dose. Further discussion of the findings are as follows.

Study Design

The T128N/P129A/Q286R/M298Q FVIIa polypeptide was provided in vials containing 4.6 mg of the drug product, and was reconstituted with 2.2 ml of sterile water to a concentration of 2.1 mg/mL, and immediately frozen. The vehicle control consisted of the vehicle in which the T128N/P129A/Q286R/M298Q FVIIa polypeptide was formulated, as follows: 10 mM L-Histidine, 29 mM Sucrose, 390 mM Glycine, 10 mM Calcium chloride dihydrate, 3.35 mM L-Methionine, and 0.03% Tween-80, at pH 6.0. The dosing regimens used in the study are provided below in Table 16-1.

TABLE 16-1

| Dosing Regimens Across Treatment Arms | | | | | | | |
|---|---|---|---|---|---|---|---|
| Group | n | Dose | Volume | Route | 1st dose | 2nd dose | 3rd dose | Endpoint |
| Vehicle | 6 | 0 μg/kg | 1 mL/kg | SC | 0 hours | 3 ± 0.5 hours if needed | 6 ± 1 hours if needed | 24 hours |
| T128N/P129A/Q286R/M298Q FVIIa | 6 | 385 μg/kg | 1 mL/kg | SC | 0 hours | 3 ± 0.5 hours if needed | 6 ± 1 hours if needed | 24 hours |

The severity scoring of bleeds, and examples of each scoring, are presented in Table 16-2 below.

TABLE 16-2

Severity Scoring of Bleeds with Examples

| Table 2-2 Severity Scoring of Bleeds With Examples Classification | Examples of bleed locations (including but not limited to the following) |
|---|---|
| Mild | Bruises, scrapes, superficial muscle, oral, or nose bleeds |
| Moderate | Early or uncomplicated hemarthrosis of joints, hematuria, intramuscular or soft tissue with or without dissection but without neurovascular compromise |
| Severe | Complicated or more extensive hemarthrosis of joints, deep muscle bleeds (iliopsoas, calf, forearm), gastrointestinal (GI) bleeds |
| Life-threatening | Intracranial, intrathoracic, retroperitoneal, or retropharyngeal bleeds; fractures, head trauma, or limb threatening bleeds. |

Results

Twelve F8−/− rats were enrolled in the study, and data were recorded for 14 independent bleeding events in total. The age of the rats at the first observed bleed ranged from 22 to 76 days. The number of days between the first and second bleeding events were 15 and 22 days in the two animals that were observed with each and treated for two bleeds each in a crossover regimen as allowed per the protocol. There was no significant difference in age at treatment between the two groups (P=0.33).

Figures 25A, 25B:
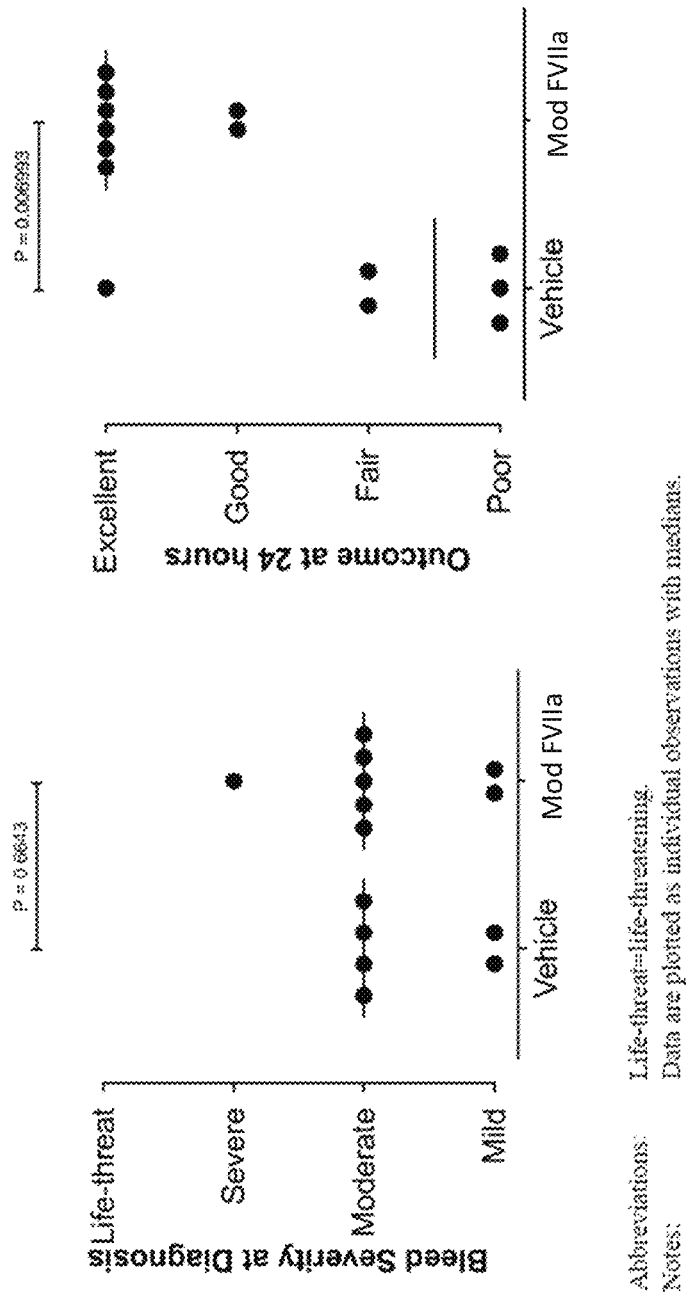
FIGS. 25A-25B depict the severity bleeding score at the start and overall treatment outcome in the rats having spontaneous bleeding, respectively, wherein the rats were treated with subcutaneous administration of the T128N/P129A/Q286R/M298Q FVIIa polypeptide, or with a vehicle.

As scored by severity, the types of non-life-threatening bleeds were four mild, nine moderate, and one severe bleed were recorded on the first occasion when associated symptoms were observed. The distribution of bleed severity was random and comparable (P=0.66) across the two treatment groups of rats allocated to receive either the T128N/P129A/Q286R/M298Q FVIIa polypeptide or vehicle. FIGS. 25A-25B depict the severity bleeding score at the start and overall treatment outcome in the rats having spontaneous bleeding, respectively, wherein the rats were treated with SQ administration of the T128N/P129A/Q286R/M298Q FVIIa polypeptide at 385 μg/kg, or vehicle, up to three times.

A total of independent 14 bleeding events were treated. Ten rats were treated for one bleeding event each and two rats were treated for two bleeding events each with the crossover assignment. In the control group, six rats were treated with vehicle for mild or moderate bleeds. As assessed by clinical scoring 24 hours after the first dose, one rat was treated with SC vehicle control for a mild bleed that resolved spontaneously. The other five rats in the control group failed to respond to treatment with either a fair (n=2) or poor outcome (n=3). Overall, efficacy as assessed by fraction of treatment successes out of the total number treatments in the group was 17% for the vehicle control group.

In contrast, in the active treatment group, six rats received a single dose of the T128N/P129A/Q286R/M298Q FVIIa polypeptide, one rat received two doses, and one rat received three doses, all per protocol, for a total of 8 treated bleeds. In all cases, no animals showed any adverse effects to the SC treatment of the T128N/P129A/Q286R/M298Q FVIIa polypeptide including at the injection site. Notably, the rat that was dosed with the maximum allowed three times presented with the only severe bleed observed in the study (JRAJ15.2c, shown in Table 17-1 below). Of the eight rats treated, two rats showed a good response and improvement, while six rats had an excellent outcome to therapy such that as assessed by the binary failure/success ratio the T128N/P129A/Q286R/M298Q FVIIa polypeptide achieved 100% efficacy in this experiment. A summary of these doses and outcomes are presented in Table 17-1 below, and a summary of the bleeding origins with treatment outcomes of the rats is presented in Table 17-2 below.

Table 17-1

| Rat ID | Age in Days | Severity | Group | Dose μg/kg | Number of Doses | Total Dose (μg/kg) | Outcome |
|---|---|---|---|---|---|---|---|
| JRAJ19.5d | 22 | 2 | Vehicle | 0 | 3 | 0 | Poor |
| JRAJ17.4d | 28 | 2 | Mod FVIIa | 385 | 2 | 770 | Good |
| JRAJ17.3h | 33 | 2 | Mod FVIIa | 385 | 1 | 385 | Excellent |
| JRAJ15.2c a | 35 | 3 | Mod FVIIa | 385 | 3 | 1155 | Good |
| JRAJ19.3j | 37 | 1 | Mod FVIIa | 385 | 1 | 385 | Excellent |
| JRAJ3.2f a | 37 | 2 | Mod FVIIa | 385 | 1 | 385 | Excellent |
| JRAJ22.1g | 37 | 2 | Vehicle | 0 | 1 | 0 | Poor |
| JRAJ1.4j | 49 | 2 | Mod FVIIa | 385 | 1 | 385 | Excellent |
| JRAJ11.2g | 49 | 1 | Mod FVIIa | 385 | 1 | 385 | Excellent |
| JRAJ15.2c a | 50 | 2 | Vehicle | 0 | 1 | 0 | Fair |
| JRAJ3.2f a | 59 | 1 | Vehicle | 0 | 1 | 0 | Excellent |
| JRA17.4i | 60 | 1 | Vehicle | 0 | 2 | 0 | Poor |
| JRAJ19.4 a | 67 | 2 | Vehicle | 0 | 1 | 0 | Fair |
| JRAJ4.1j | 76 | 2 | Mod FVIIa | 385 | 1 | 385 | Excellent |

Abbreviations: Mod FVIIa = T128N/P129A/Q286R/M298Q FVIIa a Rat received both vehicle and Mod FVIIa in crossover treatment.

TABLE 17-2

Origin of Bleeding and Treatment Outcome Over 24 hours in Hemophilia A Rats With Spontaneous Bleedings Treated With T128N/P129A/Q286R/M298Q FVIIa Polypeptide or Vehicle

| HA Rat | Bleeding | Treatment | Observations at +2 h | Observations at +4 h | Observations at +24 h | Outcome |
|---|---|---|---|---|---|---|
| T128N/P129A/Q286R/M298Q FVIIa polypeptide ||||||| 
| JRAJ4.1j | Swollen foot | Rx Significantly swollen | No change | No worsening slightly improved | Seems fine, definite improvement | Resolved |
| JRAJ19.3j | Hind paw swollen and bruised | Rx 60% bruising of foot | Not guarding foot | Seems fine | Significant improvement, still slightly pink/red mild bruising | Resolved |
| JRAJ17.3h | Head bleed | Rx | Seems fine | Seems fine | Seems fine, improved | Resolved |
| JRAJ1.4j | Swollen hind leg | Rx | Animal walking | Leg improved, no swelling | Seems fine, no signs of swelling | Resolved |
| JRAJ11.2g | Penile bleeding | Rx Bleeding area cleaned | No further blood | Seems fine | Seems fine, no further blood | Resolved |
| JRAJ17.4d | Head bleed | Rx 30% of left area of face | Rx Area not increased | Significantly improved | Seems fine, no blood around the ear or eye | Resolved |
| JRAJ3.2f [a] | Digit and top of foot | Rx 80% of foot area | Digit pink 50% of foot area | No further pinkness 30% of foot area | Seems fine | Resolved |
| JRAJ15.2c [a] | Front limb bleed | Rx Holding leg, not placing on floor | Rx Guarding leg | Rx Guarding leg | Bright and moving around, guarding leg slightly showing a little lameness. No distress and bleed not worsened | Resolved |
| Vehicle |||||||
| JRAJ3.2f [a] | Front limb bleed | Rx Bruising of foot 50% of foot area | No change | Little change 40% of foot area | Significant improvement, little swelling and skin pink | Resolved |
| JRAJ15.2c [a] | Front limb bleed | Rx Holding leg | Edema starting, foot dark pink | Swelling pronounced | Increased swelling of foot | Failure |
| JRAJ19.5d | Joint bleed - foot | Rx Foot swollen, dark bruising covering 50% of top of foot | No change | Noticeable swollen and bruising | No improvement, bruising covering 50-60% of top of foot | Failure |
| JRAJ17.4i | Urinary bleed | Rx Area swollen and pink, blood removed | Rx No improvement, evidence of further blood | No further evidence of blood, area red and swollen | Small drop of blood. Licking, red and swollen | Failure |
| JRAJ19.4a | Joint bleed - foot | Rx Curled foot, no sign of bleeding | Rx Reduced weight bearing, foot red and swollen | Rx Noticeably swollen, guarding foot | Progression rapid, whole foot red and swollen (animal euthanized next day) | Failure |
| JRAJ22.1g | Joint bleed - foot | Rx Back right ankle slightly bruised and curled up | No change to earlier. Rat is not guarding foot and is walking as normal, so no further treatment given | Little change to before although foot is bruised and has noticeable swelling and bruising | No improvement overnight. Bruising still covering ~20-30% of the foot and ankle area. Rat is not guarding the foot although foot is markedly curled up. No impairment in walking | Failure |

Abbreviations: Rx = T128N/P129A/Q286R/M298Q FVIIa polypeptide 385 µg/kg SQ or vehicle SQ.
[a] Rat received both T128N/P129A/Q286R/M298Q FVIIa polypeptide and vehicle in crossover treatment.

Of the two rats that received crossover treatment, 1) JRAJ15.2c had a good outcome for a severe bleed when treated with the T128N/P129A/Q286R/M298Q FVIIa polypeptide, but only a fair outcome when treated with vehicle for a moderately severe bleed; and 2) JRAJ3.2f had an excellent outcome for a moderately severe bleed treated with the T128N/P129A/Q286R/M298Q FVIIa polypeptide and an excellent outcome for a vehicle-treated mild bleed.

When compared with the vehicle control, rats treated with the T128N/P129A/Q286R/M298Q FVIIa polypeptide showed a distinct improvement and statistically significant superiority (P=0.007).

The more serious bleeds (one severe and one moderate) were the bleeds that required the most intense therapy to resolve. The data reported also showed that only one of the mild and none of the moderate bleeds recovered spontaneously. The subcutaneous administration of the T128N/P129A/Q286R/M298Q FVIIa polypeptide showed to be effective for on-demand treatment of spontaneous bleeding events in HA rats. The efficacy of SQ T128N/P129A/Q286R/M298Q FVIIa polypeptide was 100% after one to three therapeutic doses for treatment of mild, moderate, and severe bleeds. In comparison, only one of six rats treated with SQ vehicle had a positive treatment outcome; all other vehicle-treated animals saw either no improvement or significant deterioration of the bleeding event over 24 hours following the first dose. These results support that the SQ administration of the T128N/P129A/Q286R/M298Q FVIIa polypeptide has the capacity to treat a bleed on-demand, after the bleeding has started, and that most of the bleeds would not have resolved without therapeutic intervention.

Example 13

Comparative Noncompartmental Pharmacokinetics of Various Modified and Unmodified FVIIa Polypeptides Following Intravenous and Subcutaneous Administration in Rats The pharmacokinetics (PK) of the T128N/P129A/Q286R/M298Q FVIIa polypeptide, the Q286R/M298Q FVIIa polypeptide, and the unmodified FVIIa polypeptide (referred to herein as recombinant FVIIa or rFVIIa) were evaluated after single intravenous (IV) or subcutaneous (SQ) administration. Each were given as a single IV or SQ dose to thirty-one rats.

The IV dosing was as follows: 0.3 mg/kg of T128N/P129A/Q286R/M298Q FVIIa polypeptide and the Q286R/M298Q FVIIa polypeptide and 0.6 mg/kg of rFVIIa, while the SQ dosing was as follows: 1.5 mg/kg of T128N/P129A/Q286R/M298Q FVIIa polypeptide and Q286R/M298Q FVIIa polypeptide and 3 mg/kg of rFVIIa. The rats were randomly allocated to six groups, with blood sampling taking place pre-dose and 0.083, 0.25, 0.5, 1, 2, 3, 4, 6 and 8 hours after the dose for the IV group and pre-dose and 0.083, 0.25, 0.5, 1, 2, 4, 6, 8, 10, 12, 16 and 24 hours post-dose for the SQ group. In the process of the study, additional fifteen rats were allocated to the SQ groups (T128N/P129A/Q286R/M298Q n=6, Q286R/M298Q n=6 and rFVIIa n=3) with two sampling points at 0.5 and 16 hours after T128N/P129A/Q286R/M298Q and Q286R/M298Q, and three sample points at 0, 0.5 and 16 hours after rFVIIa. Drug concentrations were determined using STA-CLOT® VIIa-TF assay. Noncompartmental analysis (NCA) was performed using Phoenix WinNonlin™ and the following parameters were derived: elimination rate constant ($k_e$), elimination half-life ($t^{1/2}$), maximum concentration observed ($C_{max}$) along with time maximal concentration ($t_{max}$), time of the last observed sample ($t_{last}$), area under the concentration-time curve from time zero to the time of the last measured sample ($AUC_{(0-last)}$), area under the concentration-time curve from time zero to infinity ($AUC_{(0-\infty)}$), volume of distribution ($V_d$), and clearance (CL). Bioavailability between IV and SQ for each compound was derived by computing the ratio of the mean of the dose-normalized $AUC_{(0-\infty)}$ of the SC route to the mean of the dose-normalized $AUC_{(0-\infty)}$ of the IV route. The 16 hours samples were pooled with all post $C_{max}$ samples in order to derive mean half-lives for all three drugs after IV and SC administration using linear regression.

Statistical differences in NCA-derived PK parameters between the three compounds were evaluated using one-way unpaired ANOVA adjusted for multiple comparisons. For the IV groups, a statistical difference was seen in $k_e$ between rFVIIa and the other two drugs. For the SQ group, a statistical difference was observed in ($AUC_{(0-\infty)}$)/Dose between the T128N/P129A/Q286R/M298Q FVIIa polypeptide and the other two drugs but not in $k_e$. The bioavailability was calculated to be 22.0% for the T128N/P129A/Q286R/M298Q FVIIa polypeptide, 15.2% for the Q286R/M298Q polypeptide and 11.3% for rFVIIa. The mean $t\_^{1/2}$, derived using regression analysis, after IV administration were 1.68, 1.76 and 1.16 hours for the T128N/P129A/Q286R/M298Q FVIIa polypeptide, The Q286R/M298Q polypeptide and rFVIIa, respectively. The longest $t\_^{1/2}$ was seen after SC administration of the T128N/P129A/Q286R/M298Q FVIIa polypeptide which was twice as long compared to rFVIIa and the Q286R/M298Q polypeptide. The mean $t\_^{1/2}$ were 5.01, 3.00 and 2.57 hours after SC administration of the T128N/P129A/Q286R/M298Q FVIIa polypeptide, the Q286R/M298Q polypeptide and rFVIIa, respectively. A total of fifteen animals were excluded from the NCA due to contamination, hemolysis, or clotting.

Individual PK parameter estimates along with the dose-normalized PK parameters are listed along with a statistical summary for both IV and SQ dosing in Tables 18-1 and 18-2, respectively. Asterisks are given next to the PK parameters that were significantly different.

TABLE 18-1

Statistical summary of PK parameters per ID and compound following IV dosing

| Drug | Dose (mg/kg) | ID | $k_e$ ($h^{-1}$) | $t_{1/2}$ (h) | $t_{max}$ (h) | $C_{max}$ (ng/ml) | $C_{max}$/Dose (kg/m1) | $t_{last}$ (h) | $AUC_{0-last}$ (h · ng/m1) | $AUC_{0-last}$/Dose (h · kg/ml) | $AUC_{0-\infty}$ (h · ng/ml) |
|---|---|---|---|---|---|---|---|---|---|---|---|
| Q286R/ | 0.3 | 7 | 0.4 | 1.75 | 0.083 | 5293 | 0.018 | 8 | 4869 | 0.016 | 5001 |
| M298Q | | 8 | 0.42 | 1.65 | 0.083 | 3509 | 0.012 | 8 | 4727 | 0.016 | 4894 |
| FVIIa | | 9 | 0.34 | 2.03 | 0.083 | 1888 | 0.0063 | 8 | 2923 | 0.0097 | 3104 |
| | | 10 | 0.55 | 1.27 | 0.083 | 3269 | 0.011 | 8 | 4194 | 0.014 | 4269 |

TABLE 18-1-continued

Statistical summary of PK parameters per ID and compound following IV dosing

|  |  |  |  |  |  |  |  |  |  |  |  |
|---|---|---|---|---|---|---|---|---|---|---|---|
|  |  | 11 | 0.24 | 2.86 | 0.25 | 459.1 | 0.0015 | 8 | 1438 | 0.0048 | 1746 |
|  |  | 12 | 0.42 | 1.67 | 0.083 | 2542 | 0.0085 | 8 | 3416 | 0.011 | 3498 |
|  |  | n | 6 | 6 | 6 | 6 | 6 | 6 | 6 | 6 | 6 |
|  |  | Mean | 0.39*[†] | 1.87 | 0.11 | 2827***[†] | 0.0094 | 8 | 3594***[†] | 0.012 | 3752***[†] |
|  |  | SD | 0.1 | 0.54 | 0.068 | 1632 | 0.0054 | 0 | 1296 | 0.0043 | 1236 |
|  |  | CV % | 26 | 29 | 62 | 58 | 58 | 0 | 36 | 36 | 33 |
|  |  | Min | 0.24 | 1.27 | 0.083 | 459.1 | 0.0015 | 8 | 1438 | 0.0048 | 1746 |
|  |  | Median | 0.41 | 1.71 | 0.083 | 2906 | 0.0097 | 8 | 3805 | 0.013 | 3883 |
|  |  | Max | 0.55 | 2.86 | 0.25 | 5293 | 0.018 | 8 | 4869 | 0.016 | 5001 |
| T128N/ | 0.3 | 1 | 0.4 | 1.74 | 0.25 | 3480 | 0.012 | 8 | 6164 | 0.021 | 6378 |
| P129A/ |  | 2 | 0.22 | 3.22 | 0.25 | 3892 | 0.013 | 8 | 5395 | 0.018 | 5757 |
| Q286R/ |  | 3 | 0.21 | 3.27 | 0.083 | 1040 | 0.0035 | 8 | 2894 | 0.0096 | 3416 |
| M298Q |  | 4 | 0.44 | 1.58 | 0.083 | 3673 | 0.012 | 8 | 6022 | 0.02 | 6230 |
| FVIIa |  | 5 | 0.36 | 1.94 | 0.083 | 1219 | 0.0041 | 8 | 3168 | 0.011 | 3339 |
|  |  | 6 | 0.45 | 1.55 | 0.083 | 3709 | 0.012 | 8 | 6579 | 0.022 | 6775 |
|  |  | n | 6 | 6 | 6 | 6 | 6 | 6 | 6 | 6 | 6 |
|  |  | Mean | 0.34**[Ω] | 2.22 | 0.14 | 2836***[Ω] | 0.0095 | 8 | 5037*[Ω] | 0.017 | 5316*[Ω] |
|  |  | SD | 0.11 | 0.81 | 0.086 | 1329 | 0.0044 | 0 | 1602 | 0.0053 | 1536 |
|  |  | CV % | 31 | 36 | 62 | 47 | 47 | 0 | 32 | 32 | 29 |
|  |  | Min | 0.21 | 1.55 | 0.083 | 1040 | 0.0035 | 8 | 2894 | 0.0096 | 3339 |
|  |  | Median | 0.38 | 1.84 | 0.083 | 3577 | 0.012 | 8 | 5708 | 0.019 | 5994 |
|  |  | Max | 0.45 | 3.27 | 0.25 | 3892 | 0.013 | 8 | 6579 | 0.022 | 6775 |
| rFVII | 0.6 | 37 | 0.48 | 1.45 | 0.083 | 6118 | 0.02 | 8 | 7894 | 0.026 | 8024 |
|  |  | 38 | 0.59 | 1.17 | 0.083 | 6748 | 0.011 | 8 | 7935 | 0.013 | 7999 |
|  |  | 39 | 0.5 | 1.39 | 0.083 | 8548 | 0.014 | 8 | 7775 | 0.013 | 7995 |
|  |  | 40 | 0.44 | 1.59 | 0.083 | 6593 | 0.011 | 8 | 6181 | 0.01 | 6274 |
|  |  | 41 | 0.64 | 1.08 | 0.083 | 7238 | 0.012 | 8 | 7679 | 0.013 | 7740 |
|  |  | 42 | 0.66 | 1.05 | 0.083 | 6704 | 0.011 | 8 | 7175 | 0.012 | 7228 |
|  |  | n | 6 | 6 | 6 | 6 | 6 | 6 | 6 | 6 | 6 |
|  |  | Mean | 0.55[†Ω] | 1.29 | 0.083 | 6992[†Ω] | 0.013 | 8 | 7440[†Ω] | 0.015 | 7543[†Ω] |
|  |  | SD | 0.092 | 0.22 | 0 | 842.3 | 0.0037 | 0 | 674.5 | 0.0058 | 691.9 |
|  |  | CV % | 17 | 17 | 0 | 12 | 27 | 0 | 9.1 | 40 | 9.2 |
|  |  | Min | 0.44 | 1.05 | 0.083 | 6118 | 0.011 | 8 | 6181 | 0.01 | 6274 |
|  |  | Median | 0.54 | 1.28 | 0.083 | 6726 | 0.012 | 8 | 7727 | 0.013 | 7868 |
|  |  | Max | 0.66 | 1.59 | 0.083 | 8548 | 0.02 | 8 | 7935 | 0.026 | 8024 |

| Drug | Dose (mg/kg) | ID | $AUC_{0-\infty}$/Dose (h·kg/ml) | $V_D$ (ml/h·kg) | CL (ml/kg) |
|---|---|---|---|---|---|
| Q286R/ | 0.3 | 7 | 0.017 | 152 | 60 |
| M298Q |  | 8 | 0.016 | 146 | 61 |
| FVIIa |  | 9 | 0.01 | 283 | 97 |
|  |  | 10 | 0.014 | 128 | 70 |
|  |  | 11 | 0.0058 | 709 | 170 |
|  |  | 12 | 0.012 | 206 | 86 |
|  |  | n | 6 | 6 | 6 |
|  |  | Mean | 0.013 | 271 | 91 |
|  |  | SD | 0.0041 | 222 | 42 |
|  |  | CV % | 33 | 82 | 46 |
|  |  | Min | 0.0058 | 128 | 60 |
|  |  | Median | 0.013 | 179 | 78 |
|  |  | Max | 0.017 | 709 | 170 |
| T128N/ | 0.3 | 1 | 0.021 | 118 | 47 |
| P129A/ |  | 2 | 0.019 | 242 | 52 |
| Q286R/ |  | 3 | 0.011 | 415 | 88 |
| M298Q |  | 4 | 0.021 | 110 | 48 |
| FVIIa |  | 5 | 0.011 | 251 | 90 |
|  |  | 6 | 0.023 | 99.3 | 44 |
|  |  | n | 6 | 6 | 6 |
|  |  | Mean | 0.018 | 206 | 62 |
|  |  | SD | 0.0051 | 123 | 21 |
|  |  | CV % | 29 | 60 | 35 |
|  |  | Min | 0.011 | 99.3 | 44 |
|  |  | Median | 0.02 | 180 | 50 |
|  |  | Max | 0.023 | 415 | 90 |
| rFVII | 0.6 | 37 | 0.027 | 78 | 37 |
|  |  | 38 | 0.013 | 127 | 75 |
|  |  | 39 | 0.013 | 150 | 75 |
|  |  | 40 | 0.01 | 220 | 96 |

TABLE 18-1-continued

Statistical summary of PK parameters per ID and compound following IV dosing

|  |  |  |  |
|---|---|---|---|
| 41 | 0.013 | 121 | 78 |
| 42 | 0.012 | 126 | 83 |
| n | 6 | 6 | 6 |
| Mean | 0.015 | 137 | 74 |
| SD | 0.006 | 46.8 | 20 |
| CV % | 40 | 34 | 26 |
| Min | 0.01 | 78 | 37 |
| Median | 0.013 | 126 | 76 |
| Max | 0.027 | 220 | 96 |

Tukey-adjusted p-value: *p-value < 0.05, p-value < 0.01, *p-value < 0.001

[¥]significant difference between Q286R/M298Q FVIIa and T128N/P129A/Q286R/M298Q FVIIa

[†]significant difference between Q286R/M298Q FVIIa and rFVIIa

[Ω]significant difference between T128N/P129A/Q286R/M298Q FVIIa and rFVIIa

TABLE 18-2

Statistical summary of PK parameters per ID and compound following SC dosing

| Drug | Dose (mg/kg) | ID | $k_e$ ($h^{-1}$) | $t_{1/2}$ (h) | $t_{max}$ (h) | $C_{max}$ (ng/ml) | $C_{max}$/Dose (kg/ml) | $t_{last}$ (h) | $AUC_{0-last}$ (h·ng/ml) | $AUC_{0-last}$/Dose (h·kg/ml) | $AUC_{0-\infty}$ (h·ng/ml) |
|---|---|---|---|---|---|---|---|---|---|---|---|
| Q286R/ M298Q FVIIa | 1.5 | 19 | 0.29 | 2.42 | 2 | 277 | 0.00018 | 12 | 1969 | 0.0013 | 2122 |
|  |  | 20 | 0.4 | 1.73 | 2 | 360 | 0.00024 | 12 | 2217 | 0.0015 | 2328 |
|  |  | 21 | 0.21 | 3.31 | 4 | 423 | 0.00028 | 12 | 2914 | 0.0019 | 3345 |
|  |  | 22 | 0.27 | 2.6 | 2 | 894 | 0.0006 | 12 | 4244 | 0.0028 | 4492 |
|  |  | 23 | 0.34 | 2.01 | 2 | 415 | 0.00028 | 12 | 2428 | 0.0016 | 2561 |
|  |  | 24 | 0.38 | 1.83 | 2 | 344 | 0.00023 | 12 | 2141 | 0.0014 | 2228 |
|  |  | n | 6 | 6 | 6 | 6 | 6 | 6 | 6 | 6 | 6 |
|  |  | Mean | 0.31 | 2.32 | 23*[†] | 452 | 0.0003 | 12 | 2652 | 0.0018*[¥] | 2846*[¥] |
|  |  | SD | 0.073 | 0.59 | 0.82 | 223 | 0.00015 | 0 | 845.1 | 0.00056 | 918.1 |
|  |  | CV % | 23 | 25 | 35 | 49 | 49 | 0 | 32 | 32 | 32 |
|  |  | Min | 0.21 | 1.73 | 2 | 277 | 0.00018 | 12 | 1969 | 0.0013 | 2122 |
|  |  | Median | 0.32 | 2.22 | 2 | 387 | 0.00026 | 12 | 2322 | 0.0015 | 2445 |
|  |  | Max | 0.4 | 3.31 | 4 | 894 | 0.0006 | 12 | 4244 | 0.0028 | 4492 |
| T128N/ P129A/ Q286R/ M298Q FVIIa | 1.5 | 13 | — | — | 10 | 339 | 0.00023 | 12 | 3178 | 0.0021 | — |
|  |  | 14 | 0.083 | 8.32 | 1 | 567 | 0.00038 | 12 | 4462 | 0.003 | 7152 |
|  |  | 15 | — | — | 6 | 292 | 0.00019 | 12 | 2949 | 0.002 | — |
|  |  | 16 | — | — | 2 | 528 | 0.00035 | 12 | 3842 | 0.0026 | — |
|  |  | 17 | — | — | 4 | 461 | 0.00031 | 12 | 4637 | 0.0031 | — |
|  |  | 18 | 0.21 | 3.38 | 4 | 422 | 0.00028 | 12 | 3788 | 0.0025 | 4564 |
|  |  | n | 2 | 2 | 6 | 6 | 6 | 6 | 6 | 6 | 2 |
|  |  | Mean | 0.14 | 5.85 | 4.5***[Ω] | 435 | 0.00029 | 12 | 3809 | 0.0025[¥Ω] | 5858*[¥] |
|  |  | SD[a] | — | — | 3.2 | 106 | 7.10E-05 | 0 | 670.9 | 0.00045 | — |
|  |  | CV %[a] | — | — | 71 | 24 | 24 | 0 | 18 | 18 | — |
|  |  | Min | 0.083 | 3.38 | 1 | 292 | 0.00019 | 12 | 2950 | 0.002 | 4564 |
|  |  | Median | 0.14 | 5.85 | 4 | 442 | 0.00029 | 12 | 3810 | 0.0025 | 5858 |
|  |  | Max | 0.21 | 8.32 | 10 | 567 | 0.00038 | 12 | 4637 | 0.0031 | 7152 |
| rFVIIa | 3 | 46 | 0.26 | 2.71 | 6 | 445 | 0.00015 | 12 | 3449 | 0.0011 | 3839 |
|  |  | 47 | 0.23 | 3.03 | 6 | 731 | 0.00024 | 12 | 4786 | 0.0016 | 5661 |
|  |  | 48 | 0.24 | 2.93 | 6 | 487 | 0.00016 | 12 | 3568 | 0.0012 | 4216 |
|  |  | 49 | 0.18 | 3.84 | 6 | 552 | 0.00018 | 12 | 3563 | 0.0012 | 4431 |
|  |  | 50 | — | — | 8 | 388 | 0.00013 | 12 | 3165 | 0.0011 | — |
|  |  | 51 | 0.39 | 1.78 | 6 | 349 | 0.00012 | 12 | 2995 | 0.001 | 3156 |
|  |  | n | 5 | 5 | 6 | 6 | 6 | 6 | 6 | 6 | 5 |
|  |  | Mean | 0.26 | 2.86 | 6.3[†Ω] | 492 | 0.00016 | 12 | 3588 | 0.0012**[Ω] | 4261 |
|  |  | SD | 0.079 | 0.74 | 0.82 | 137 | 4.60E-05 | 0 | 630 | 0.00021 | 920.6 |
|  |  | CV % | 30 | 26 | 13 | 28 | 28 | 0 | 18 | 18 | 22 |
|  |  | Min | 0.18 | 1.78 | 6 | 349 | 0.00012 | 12 | 2995 | 0.001 | 3156 |
|  |  | Median | 0.24 | 2.93 | 6 | 466 | 0.00016 | 12 | 3506 | 0.0012 | 4216 |
|  |  | Max | 0.39 | 3.84 | 8 | 731 | 0.00024 | 12 | 4786 | 0.0016 | 5661 |

| Drug | Dose (mg/kg) | ID | $AUC_{0-\infty}$/Dose (h·kg/ml) | $V_D/F$ (ml/kg) | CL/F (ml/h·kg) |
|---|---|---|---|---|---|
| Q286R/ M298Q FVIIa | 1.5 | 19 | 0.0014 | 2471 | 707 |
|  |  | 20 | 0.0016 | 1611 | 644 |
|  |  | 21 | 0.0022 | 2139 | 448 |
|  |  | 22 | 0.003 | 1253 | 334 |

TABLE 18-2-continued

Statistical summary of PK parameters per ID and compound following SC dosing

|  |  |  |  |  |  |
|---|---|---|---|---|---|
|  |  | 23 | 0.0017 | 1700 | 586 |
|  |  | 24 | 0.0015 | 1780 | 673 |
|  |  | n | 6 | 6 | 6 |
|  |  | Mean | 0.0019**¥ | 1826*† | 565*¥ |
|  |  | SD | 0.00061 | 426 | 150 |
|  |  | CV % | 32 | 23 | 26 |
|  |  | Min | 0.0014 | 1253 | 334 |
|  |  | Median | 0.0016 | 1740 | 615 |
|  |  | Max | 0.003 | 2471 | 707 |
| T128N/ | 1.5 | 13 | — | — | — |
| P129A/ |  | 14 | 0.0048 | 2517 | 210 |
| Q286R/ |  | 15 | — | — | — |
| M298Q |  | 16 | — | — | — |
| FVIIa |  | 17 | — | — | — |
|  |  | 18 | 0.003 | 1602 | 329 |
|  |  | n | 2 | 2 | 2 |
|  |  | Mean | 0.0039¥Ω | 2059 | 269¥Ω |
|  |  | SD$^a$ | — | — | — |
|  |  | CV %$^a$ | — | — | — |
|  |  | Min | 0.003 | 1602 | 210 |
|  |  | Median | 0.0039 | 2059 | 269 |
|  |  | Max | 0.0048 | 2517 | 329 |
| rFVIIa | 3 | 46 | 0.0013 | 3057 | 782 |
|  |  | 47 | 0.0019 | 2319 | 530 |
|  |  | 48 | 0.0014 | 3011 | 712 |
|  |  | 49 | 0.0015 | 3751 | 677 |
|  |  | 50 | — | — | — |
|  |  | 51 | 0.0011 | 2438 | 950 |
|  |  | n | 5 | 5 | 5 |
|  |  | Mean | 0.0014**Ω | 2915*† | 730**Ω |
|  |  | SD | 0.00031 | 572.2 | 150 |
|  |  | CV % | 22 | 20 | 21 |
|  |  | Min | 0.0011 | 2319 | 530 |
|  |  | Median | 0.0014 | 3011 | 712 |
|  |  | Max | 0.0019 | 3751 | 950 |

Tukey-adjusted p-value: * P-value < 0.05,  P-value < 0.01, * P-value < 0.001
¥significant difference between Q286R/M298Q FVIIa and T128N/P129A/Q286R/M298Q FVIIa
†significant difference between Q286R/M298Q FVIIa and rFVIIa
Ωsignificant difference between T128N/P129A/Q286R/M298Q FVIIa and rFVIIa
$^a$SD and CV not derived due to too few animals Using NCA, the mean half-life ($t_{1/2}$) after IV administration was estimated to be 2.22 hours for the T128N/P129A/Q286R/M298Q FVIIa polypeptide, 1.87 hours for the Q286R/M298Q polypeptide and 1.29 hours for rFVIIa, while the mean $t_{1/2}$ after SQ administration was estimated to be 5.85 hours for the T128N/P129A/Q286R/M298Q FVIIa polypeptide, 2.32 hours for the Q286R/M298Q polypeptide and 2.86 hours for rFVIIa. The longest $t_{1/2}$ was observed in the T128N/P129A/Q286R/M298Q FVIIa polypeptide SQ group. This parameter was estimated based on only two animals as the data from the remaining four animals had too low precision in the estimation of the elimination rate constant (adjusted-$R^2$<0.8 or <3 samples after $C_{max}$).

Based on the mean dose-adjusted $AUC_{0-\infty}$ for each drug, F was calculated to be 22.0% for the T128N/P129A/Q286R/M298Q FVIIa polypeptide, 15.2% for the Q286R/M298Q polypeptide and 11.3% for rFVIIa. These are summarized in Table 18-3 below:

TABLE 18-3

Bioavailability (%) between intravenous (IV) and subcutaneous (SC) administration of the Q286R/M298Q polypeptide, the T128N/P129A/Q286R/M298Q FVIIa polypeptide and rFVIIa

| Q286R/M298Q | | | |
|---|---|---|---|
| IV | | SC | |
| Dose | 0.3 mg/kg | Dose | 1.5 mg/kg |
| $AUC_{0-\infty}$ | 3752 ng/ml | $AUC_{0-\infty}$ | 2846 ng/ml |
| F | | | 15.2% |

| T128N/P129A/Q286R/M298Q | | | |
|---|---|---|---|
| IV | | SC | |
| Dose | 0.3 mg/kg | Dose | 1.5 mg/kg |
| $AUC_{0-\infty}$ | 5316 ng/ml | $AUC_{0-\infty}$ | 5858 ng/ml |
| F | | | 22.0% |

| rFVIIa | | | |
|---|---|---|---|
| IV | | SC | |
| Dose | 0.6 mg/kg | Dose | 3 mg/kg |
| $AUC_{0-\infty}$ | 7543 ng/ml | $AUC_{0-\infty}$ | 4261 ng/ml |
| F | | | 11.3% |

Figure 26:
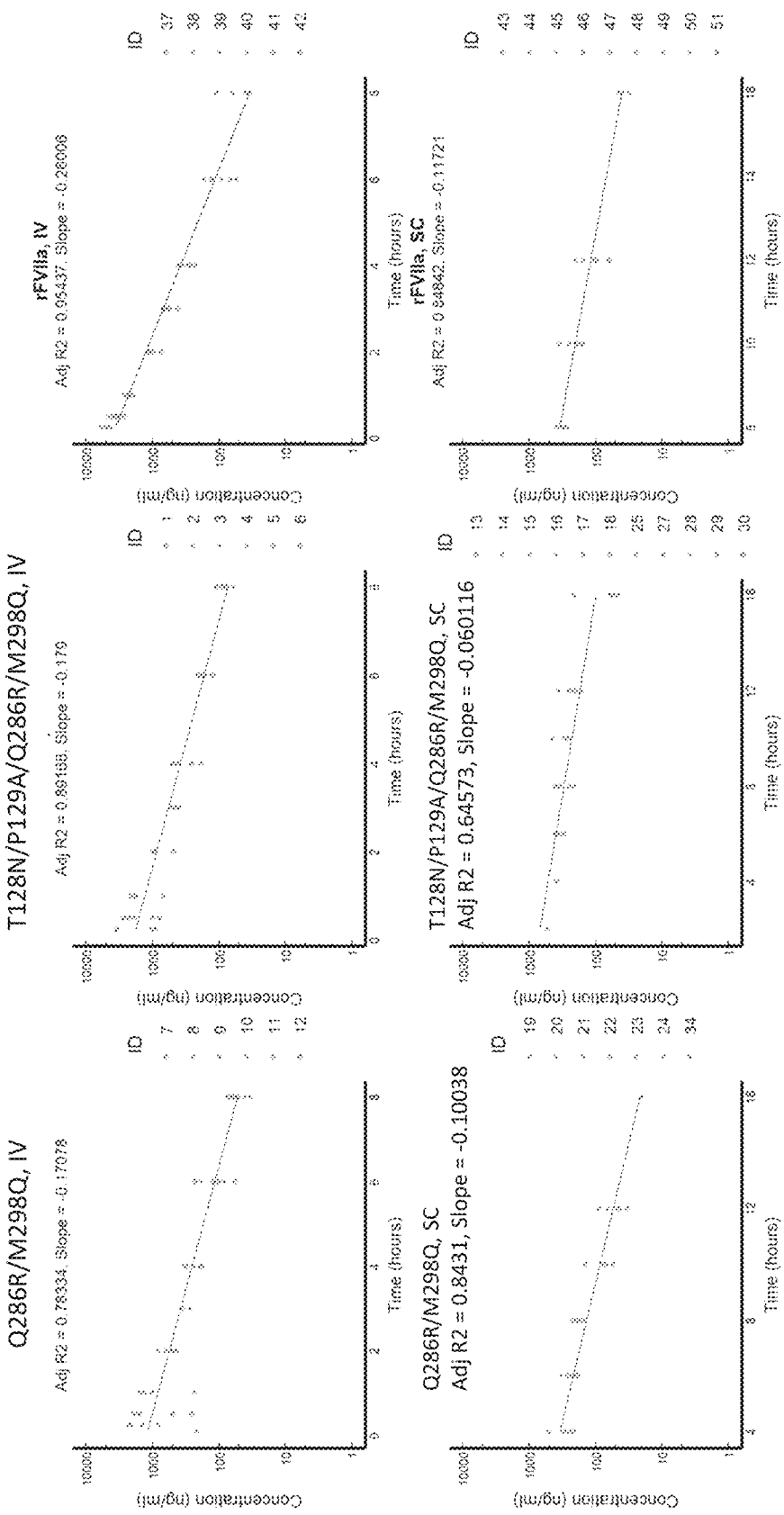
FIG. 26 depicts the pharmacokinetic observations for the estimation of mean half-life and terminal elimination half-life as a comparison between the T128N/P129A/Q286R/M298Q FVIIa polypeptide, the Q286R/M298Q FVIIa, and the unmodified recombinant FVIIa polypeptide, comparing intravenous and subcutaneous administrations of each.

Mean half-lives were also estimated for all three drugs after either IV or SQ administration using the slope of the regression line of all post-$C_{max}$ observations including all 16 hours samples of the additional fifteen animals. In the Q286R/M298Q polypeptide SQ arm, only one point out of the six 16 hours observations post-dosing was above LLOQ. This sample was 20.48 ng/ml right above the LLOQ of 20 ng/ml. FIG. 26 depicts the six concentration versus time plots on semi-log scale for each arm with a regression line, along with its adjusted-$R^2$ and estimated slope. Table 18-4 below shows the results from the linear regression.

TABLE 18-4

Estimation of mean $k_e$ and $t_{1/2}$ using regression line through pooling of all observations post $C_{max}$ and subsets of drug and route of administration

|  | Q286R/M298Q | T128N/P129A/Q286R/M298Q | rFVIIA |
|---|---|---|---|
|  | Slope from regression lines | | |
| IV | −0.17078 | −0.179 | −0.26006 |
| SC | −0.10038 | −0.060116 | −0.11721 |
|  | $k_e$ (h$^{-1}$) | | |
| IV | 0.393 | 0.412 | 0.599 |
| SC | 0.231 | 0.138 | 0.270 |
|  | t½ (h) | | |
| IV | 1.762 | 1.681 | 1.157 |
| SC | 2.998 | 5.007 | 2.568 |

In the IV arm, the mean $t_{1/2}$ were 1.68 hours for the T128N/P129A/Q286R/M298Q FVIIa polypeptide, 1.76 hours for CB813a and 1.16 hours for rFVIIa, while in the SC arm, the mean $t_{1/2}$ were 5.01 hours for the T128N/P129A/Q286R/M298Q FVIIa polypeptide, 3.00 hours for the Q286R/M298Q polypeptide and 2.57 hours for rFVIIa. Table 18-5 shows a comparison of the mean $t_{1/2}$ after NCA and regression analysis of pooled observations for both the IV and SC routes.

TABLE 18-5

A comparison of the mean $t_{1/2}$ (hours) using NCA and linear regression of pooled observations

|  | IV | | SQ | |
|---|---|---|---|---|
|  | NCA | Regression analysis | NCA | Regression analysis |
| T128N/P129A/Q286R/M298Q | 2.22 | 1.68 | 5.85 | 5.01 |
| Q286R/M298Q | 1.87 | 1.76 | 2.32 | 3.00 |
| rFVIIa | 1.29 | 1.16 | 2.86 | 2.57 |

For the IV groups, a statistical difference was seen in $k_e$ between rFVIIa and the other two drugs. The mean $k_e$ (0.55 h$^{-1}$) was significantly higher after rFVIIa than after the Q286R/M298Q polypeptide (=0.39 h$^{-1}$) or the T128N/P129A/Q286R/M298Q FVIIa polypeptide (0.34 h$^{-1}$). All dose-normalized normalized PK parameters, $$\text{e.g. } \frac{C_{max}}{\text{Dose}}, \frac{AUC_{0-last}}{\text{Dose}} \text{ and } \frac{AUC_{0-\infty}}{\text{Dose}},$$

were not significantly different.

As for the SQ group, for five animals (four in the T128N/P129A/Q286R/M298Q FVIIa polypeptide and one in rFVIIa), $k_e$, $t_{1/2}$, $$\frac{V_d}{F} \text{ and } \frac{CL}{F},$$

in addition to $AUC_{0-28}$ were not derived as the elimination slope was estimated with too low precision (adjusted-$R^2$<0.8 or <3 samples after $C_{max}$). Two rats remained in the T128N/P129A/Q286R/M298Q FVIIa polypeptide group to derive the PK parameters. A statistical difference was observed in $$\frac{AUC_{0-\infty}}{\text{Dose}} \text{ and } \frac{CL}{F}$$

between the T128N/P129A/Q286R/M298Q FVIIa polypeptide and the other two drugs. The T128N/P129A/Q286R/M298Q FVIIa polypeptide had a higher $$\frac{AUC_{0-\infty}}{\text{Dose}} (0.0039 \text{ h·kg/ml})$$

than after the Q286R/M298Q polypeptide (0.0019 h·kg/ml) and rFVIIa (0.0014 h·kg/ml) and lower $$\frac{CL}{F} (269 \text{ ml/h·kg})$$

than after the Q286R/M298Q polypeptide (565 ml/h·kg) and rFVIIa (730 ml/h·kg). A significant difference was also seen in $$\frac{V_d}{F}$$

of C the Q286R/M298Q polypeptide B813a (1826 ml/kg) and that of rFVIIa (2915 ml/kg).

SEQUENCE LISTING (371 sequences)

SEQ ID NO: 1 - protein, 466 aa, Homo sapiens
  MISC_FEATURE (1)..(466): Factor VII precursor isoform a
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 2 - protein, 444 aa, Homo sapiens
  MISC_FEATURE (1)..(444): Factor VII precursor isoform b
MVSQALRLLCLLLGLQGCLAAVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 3 - protein, 406 aa, Homo sapiens [sequence omitted]

SEQ ID NO: 4 - protein, 447 aa, Bos taurus
  MISC_FEATURE (1)..(447): Factor VII precursor
MLSQAWALALLCFLLSLWGSLPAVFLPQEQALSILHRPRRANGFLEELLPGSLERECREELCSFEEAHEIFRNEERTRQFWVSYNDGDQCASSPCQNGGSCEDQLRSYICFCPDGFEGRNCETDKQSQLICANDNGGCEQYCGADPGAGRFCWCHEGYALQADGVSCAPTVEYPCGKIPVLEKRNGSKPQGRIVGGHVCPKGECPWQAMLKLNGALLCGGTLVGPAWVVSAAHCFERLRSRGNLTAVLGEHDLSRVEGPEQERRVAQIIVPKQYVPGQTDHDVALLQLAQPVALGDHVAPLCLPDPDFADQTLAFVRFSAVSGWGQLLERGVTARKLMVVLVPRLLTQDCLQQSRQRPGGPVVTDNMFCAGYSDGSKDACKGDSGGPHATRFRGTWFLTGVVSWGEGCAAAGHFGIYTRVSRYTAWLRQLMGHPPSRQGFFQVPLLP

SEQ ID NO: 5 - protein, 446 aa, Mus musculus
  MISC_FEATURE (1)..(446): Factor VII precursor
MVPQAHGLLLLCFLLQLQGPLGTAVFITQEEAHGVLHRQRRANSLLEELWPGSLERECNEEQCSFEEAREIFKSPERTKQFWIVYSDGDQCASNPCQNGGTCQDHLKSYVCFCLLDFEGRNCEKSKNEQLICANENGDCDQYCRDHVGTKRTCSCHEDYTLQPDEVSCKPKVEYPCGRIPVVEKRNSSSRQGRIVGGNVCPKGECPWQAVLKINGLLLCGAVLLDARWIVTAAHCFDNIRYWGNITVVMGEHDFSEKDGDEQVRRVTQVIMPDKYIRGKINHDIALLRLHRPVTFTDYVVPLCLPEKSFSENTLARIRFSRVSGWGQLLDRGATALELMSIEVPRLMTQDCLEHAKHSSNTPKITENMFCAGYMDGTKDACKGDSGGPHATHYHGTWYLTGVVSWGEGCAAIGHIGVYTRVSQYIDWLVRHMDSKLQVGVFRLPLL

SEQ ID NO: 6 - protein, 466 aa, Pan paniscus
  MISC_FEATURE (1)..(466): Factor VII precursor
  UNSURE (228)..(228): Xaa could be any amino acid
  UNSURE (231)..(231): Xaa could be any amino acid
MVSQALRLLCLLLGLQGCLAAGGVAEASGGETRDMPWKPGPHRVFITQEEAHGVLHRRRRANAFLEELRPGSLERECKEEQCSFEEAREIFKDLERTKLFWISYSDGDQCASSPCQNGGSCKDQLQSYICFCLPAFEGRNCETYKDDQLICVNENGGCEQYCSDHTGTKRSCRCHEGYSLLADGVSCTPTVEYPCGKIPILENRNASKPQGRIVGGKVCPKGECPWQXLLXVNGAQLCGGTLINTIWVASAAHCFDKIKNWRNLIAVLGEHDLSEHDGDEQSRRVAQVIIPSTYIPGTTNHDIALLRLHQPVVLTDHVVPLCLPERAFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCASVGHFGVYTRVSQYIEWLQKLMRSEPRPGVLLRAPFP

SEQ ID NO: 7 - protein, 466 aa, Pan troglodytes
  MISC_FEATURE (1)..(466): Factor VII precursor
  UNSURE (35)..(36): Xaa could be any amino acid
MVSQALRLLCLLLGLQGCLAAGGVAEASGGETRDXXWKPGPHRVFITQEEAHGVLHRRRRANAFLEELRPGSLERECKEEQCSFEEAREIFKDLERTKLFWISYSDGDQCASSPCQNGGSCKDQLQSYICFCLPAFEGRNCETYKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYIPGTTNHDIALLRLHQPVVLTDHVVPLCLPERAFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCASVGHFGVYTRVSQYIEWLQKLMRSEPRPGVLLRAPFP

SEQ ID NO: 8 - protein, 444 aa, Oryctolagus cuniculus
  MISC_FEATURE (1)..(444): Factor VII precursor
MAPQARGLGLCSLLALQASLAAVFITQEEAHSVLRRQRRANSFLEELRPGSLERECKEELCSFEEAREVFQSTERTKQFWITYNDGDQCASNPCQNGGSCEDQIQSYICFCLADFEGRNCEKNKNDQLICMYENGGCEQYCSDHVGSQRSCRCHEGYTLLPNGVSCTPTVDYPCGKVPALEKRGASNPQGRIVGGKVCPKGECPWQAALMNGSTLLCGGSLLDTHWVVSAAHCFDKLSSLRNLTIVLGEHDLSEHEGDEQVRHVAQLIMPDKYVPGKTDHDIALLRLLQPAALTNNVVPLCLPERNFSESTLATIRFSRVSGWGQLLYRGALARELMAIDVPRLMTQDCVEQSEHKPGSPEVTGNMFCAGYLDGSKDACKGDSGGPHATSYHGTWYLTGVVSWGEGCAAVGHVGVYTRVSRYTEWLSRLMRSKLHHGIQRHPFP

SEQ ID NO: 9 - protein, 446 aa, Rattus norvegicus
  MISC_FEATURE (1)..(446): Factor VII precursor
MVPQTHGLLLLYFLLQLQGPLGAVVFITQEEAHGVLHRQRRANSLLEELWSSSLERECNEERCSFEEAREIFKSPERTKQFWTIYSDGDQCASNPCQNGGTCQDHLKSYVCFCPLDFEGRNCEKNKNEQLICANENGDCDQYCRDHVGTKRTCSCHEDYVLQPDEVSCKPKVEYPCGRIPVVEKRNFSRPQGRIVGGYVCPKGECPWQAVLKFNEALLCGAVLLDTRWIVTAAHCFDKFGKLVNITVVLGEHDFSEKEGTEQVRLVEQVIMPNKYTRGRTDHDIALVRLHRPVTFTDYVVPLCLPERAFSENTLASIRFSRVSGWGQLLDRGATALELMVIEVPRLMTQDCLEHAKHSANTPRITENMFCAGYMDGTKDACKGDSGGPHATHYHGTWYLTGVVSWGEGCAAIGHIGVYTRVSQYIDWLVKYMDSKLRVGISRVSLL

SEQ ID NO: 10 - protein, 469 aa, Macaca mulatta
  MISC_FEATURE (1)..(469): Factor VII precursor
MVSRALGLLCLLLGLQGCLAAATFLPQAGSLRPQEEKTQDLLWKPGPHRVFVTQEEAHGVLHRQRRANSFLEELRPGSLERECKEEQCSFEEAREIFKDLERTKLFWISYSDGDQCASNPCQNGGSCKDQLQSYICFCLPSFEGRNYKDDQLICVNENGGCEQYCSDHAGAKRSCWCHEGYSLLADGVSCMPTVEYPCGKIPILEKRNASKPQGRIVGGRVCPKGECPWQVLLLVNGAQLCGGTLINTIWVVSAAHCFDKIKSWRNLTAVLGEHDLSEHEGDEQSRRVAQVIIPSTYVLGATNHDIALLRLQQPVVLTDHVVPLCLPERMFSERTLAFVRFSLVSGWGQLLDRGATALELMALNVPRLMTQDCLQQSQKAEASPNITEYMFCAGYSDGSRDSCKGDSGGPHATRYRGTWYLTGIVSWGQGCAAVGHFGVYTRVSQYIEWLQKLMHSEPRPGVLLRAPFP

SEQ ID NO: 11 - protein, 445 aa, Sus scrofa
  MISC_FEATURE (1)..(445): Factor VII precursor (isoform b)
MASLRPALLCLLLCLQGSLAAVFVGHEEAHSLLHRFRRANSFLEELWPGSLERECREEQCSFEEAREIFKSEERTRQFWVSYNDGDQCASNPCLNGGSCEDQLQAYICFCPEGFEGRNCETNKKSQLICMNDNGGCEQYCSDHAEAGRSCWCHEGYALQEDGVSCEPTVEYPCGKIPVLEKRNDSNPQGRIVGGKVCPKGECPWQAMLKLKGALLCGGTLLNTSWVVSAAHCFDRIRSWKDLTVVLGEHDLSKDEGDEQERPVAQVFVPDKYVPGKTDHDLALVRLARPVALTDHVVPLCLPERSFSERTLAFIRFSAVSGWGRLLDRGAKARVLMAIQVPRLMTQDCLEQARRRPGSPSITDNMFCAGYLDGSKDACKGDSGGPHATRFRGTWFLTGVVSWGEGCAATGRFGVYTRVSRYTAWLLGLMSAPPPPSEGLLRAPLP

SEQ ID NO: 12 - protein, 446 aa, Canis familiaris
  MISC_FEATURE (1)..(446): Factor VII precursor
MVAWAGELALLCFLLGLQGSLAAVFLTQEEAQGVLHRQRRANSFLEELRAGSLERECREEQCSFEEAREIFQDVDRTRQFWISYKDGDQCASNPCQNGGSCEDQLQSYICFCPDDFQGRNCETDKKDQLICMNENGGCQQYCSDHAEARRSCWCHEGYTLQDDGVSCMPIVEYPCGKIPVLEKRIGSNPQGRIVGGKVCPKGECPWQAAVKVDGKLLCGGTLIDAAWVVSAAHCFERIKNWKNLTVVLGEHDLSEDDGDEQERHVARVIVPDKYIPLKTNHDIALLHLRTPVAYTDHVVPLCLPEKTFSERTLAFIRFSTVSGWGQLLDRGATALQLMAIDVPRVMTQDCQEQSRRRSGSPAITENMFCAGYLDGSKDACQGDSGGPHATKFQGTWYLTGVVSWGEGCAAEGHFGVYTRVSQYIEWLRQLMVSSHTLRGLLRAPLP

SEQ ID NO: 13 - protein, 433 aa, Brachydanio rerio
  MISC_FEATURE (1)..(433): Factor VII precursor
MSLLLVFSVLWSLHYCHSAAVFVHRDEAHEVLIRSKRANSGWFEELKTGNLERECLEEKCSYEGAREVFEHTEATNEFWKIYDVKDHCASSPCEHDGLCTTQNADSYMCLCAPGFSGRHCEQSIGDVPDSCLHDNGGCEHFCTEQDGRRNCSCADGYYLDNGGQKCRSHEVFPCGKVPLLQAGKAADHQVDLRSRIVGGSECPKGHCPWQVLLKYGEKGFCGGVIYKPTWILTAAHCLEKLKVKFLRIVAGEHDLEVDEGTEQLIQVDQMFTHPAYVSETADSDIALLRLRTPIVYSVYAVPVCLPLREMAERELWAVSKHTVSGWGKRSEDGPTSRLLRRLLVPRIRTQECVQVSNLTLTSNMFCAGYIEGRQDSCKGDSGGPLVTRYRDTAFLLGIVSWGKGCARPGSYGIYTRVSNYLQWIRQTTNTTIH

SEQ ID NO: 14 - protein, 441 aa, Fugu rubripes
  MISC_FEATURE (1)..(441): Factor VII precursor
MRLRVFFTLVFTFTHCRAASVFLDADKAHDVLVRTRRYNSGWLEELQKGDLKRECLEEICSYEEAREVFEHTKTTDEFWKIYNRPNSCKSNPCLNGGSCSAEGSSYTCFCLPEFSGVDCELEYQTVPDTCLLENGGCEHFCHENSAGQRGNCSCADGYDLDVDGLSCKAKESVACGMVLSAQFEHNQLNPRARIVGGNECPKGECPWQVLLVYKGKGFCGGVIYKPTWILTASHCMADIDVQFLKVVAGEHNTEVDEGTEQIIQVSEIIMHEKYVPRTADNDIALLHLAVPITYTTYAIPVCLPTRPLAERELWAVSLHTVSGWGRRSENGPTSHLLRQLKVPRIRTQQCIEESGVVLTQNMFCAGYMEGRQDSCKGDSGGPLVTKYKKTVFLLGIVSWGKGCARPGNYGIYTRVANYLEWIHNRTATVNQPTNNTENFTT

SEQ ID NO: 15 - protein, 425 aa, Gallus gallus
  MISC_FEATURE (1)..(425): Factor VII precursor
MVSRQCVALLLCFPLLVPPSLEAVFLKQEEANSIFQRHRRANSFFEEIKLGPLERECIEEKCSFEEAREIYRDDERTKEFWHIYSDPNQCDSSPCQNGGSCDDQFQDYVCRCPPEYEGKSCETAVAENLKCIYDNGGCEQYCADEQSEKRVCFCAEGYALASDGVSCIPQVKYPCGTIPVLARKNTTAQGRIVGGVTCPPGECPWQALIIQDQKGKCGGSLLSPEWVVTAAHCLDYAHSKQLRVRLGEYSVKVAEKTEQESGVSKIIRHEEYTIGQVNHDIALLKLETPVNLTDFVVPICLPEKRFAVYELSSIKFSMVSGWGRLLDGGATSTFLMRVHLPRVKTQECEKQANLNITENMFCAGDLTGKKDSCKGDSGGPHATKYKNTWFLTGIVSWGKGCAVEGSYGVYTRVSRYINWLKRHME

SEQ ID NO: 16 - protein, 444 aa, Pongo pygmaeus
  MISC_FEATURE (1)..(444): Factor VII (fragment)
GVAEASGGETRDMQWKLGPHRVFITQEEAHGVLHRRRRANTFLEELRPGSLERECKEEQCSFEEAREIFKDLERTKLFWISYSDGDQCASSPCQNGGSCKDQLQSYICFCLPDFEGRNCEMYKDDQLICVNENGGCEQYCSDHMGAKRSCWCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSERDGDEQSRRVAQVIIPSTYVPGTTNHDIALLRLHQPVVLTDHVVPLCLPERTFSERTLAFVRFSLVSGWGQLLDRGATALELMALNVPRLMTQDCLQQSRKVGDSPNITEYMFCAGYSDGSKDSCKGDSGGPHATRYRGTWYLTGIVSWGQGCAAVGHFGVYTRVSQYIEWLQKLMCSEPRPGVLLRAPFP

SEQ ID NO: 17 - protein, 221 aa, Gorilla gorilla
  MISC_FEATURE (1)..(221): Factor VII (fragment)
  UNSURE (172)..(172): Xaa could be any amino acid
  UNSURE (177)..(177): Xaa could be any amino acid
IWVVSAAHCFDKIKNWRNLIAVLGEHDLSEHDGDEQSRRVAQVIIPSMYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWXLTGIXSWGQGCATVGHFGVYTRVSQYIEWLQKLMRSEPRPGVLLRAPFP

SEQ ID NO: 18 - protein, 466 aa, Homo sapiens
  MISC_FEATURE (1)..(466): FVII variant L13P
MVSQALRLLCLLPGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 19 - protein, 466 aa, Homo sapiens
  MISC_FEATURE (1)..(466): FVII variant (precursor F64L)
MVSQALRLLCLLLGLQGCLAAGGVAKASGGETRDMPWKPGPHRVFVTQEEAHGVLHRRRRANALLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 20 - protein, 466 aa, Homo sapiens
  MISC_FEATURE (1)..(466): FVII variant (precursor L73Q)
MVSQALRLLCLLLGLQGCLAAGGVAKASGGETRDMPWKPGPHRVFVTQEEAHGVLHRRRRANAFLEELRPGSQERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 21 - protein, 466 aa, Homo sapiens
  MISC_FEATURE (1)..(466): FVII variant (precursor E79Q)
MVSQALRLLCLLLGLQGCLAAGGVAKASGGETRDMPWKPGPHRVFVTQEEAHGVLHRRRRANAFLEELRPGSLERECKQEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 22 - protein, 466 aa, Homo sapiens
  MISC_FEATURE (1)..(466): FVII variant (precursor S120P)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGPCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 23 - protein, 466 aa, Homo sapiens
  MISC_FEATURE (1)..(466): FVII variant (precursor C121F)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSFKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 24 - protein, 466 aa, Homo sapiens
  MISC_FEATURE (1)..(466): FVII variant (precursor L125P)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQPQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 25 - protein, 466 aa, Homo sapiens
  MISC_FEATURE (1)..(466): FVII variant (precursor Y128C)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSCICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 26 - protein, 466 aa, Homo sapiens
  MISC_FEATURE (1)..(466): FVII variant (precursor R139K)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGKNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 27 - protein, 466 aa, Homo sapiens
  MISC_FEATURE (1)..(466): FVII variant (precursor R139Q)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGQNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 28 - protein, 466 aa, Homo sapiens
  MISC_FEATURE (1)..(466): FVII variant R139W
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGWNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 29 - protein, 466 aa, Homo sapiens
  MISC_FEATURE (1)..(466): FVII variant (precursor C151S)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLISVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 30 - protein, 466 aa, Homo sapiens
  MISC_FEATURE (1)..(466): FVII variant (precursor E154K)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNKNGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 31 - protein, 466 aa, Homo sapiens
  MISC_FEATURE (1)..(466): FVII variant (precursor G157C)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGCCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 32 - protein, 466 aa, Homo sapiens
  MISC_FEATURE (1)..(466): FVII variant (precursor G157S)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGSCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 33 - protein, 466 aa, Homo sapiens
  MISC_FEATURE (1)..(466): FVII variant (precursor G157V)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGVCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 34 - protein, 466 aa, Homo sapiens
  MISC_FEATURE (1)..(466): FVII variant (precursor Q160R)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCERYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 35 - protein, 466 aa, Homo sapiens
  MISC_FEATURE (1)..(466): FVII variant (precursor P194T)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYTCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 36 - protein, 466 aa, Homo sapiens
  MISC_FEATURE (1)..(466): FVII variant (precursor C195R)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPRGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 37 - protein, 466 aa, Homo sapiens
  MISC_FEATURE (1)..(466): FVII variant (precursor K197E)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGEIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 38 - protein, 466 aa, Homo sapiens
  MISC_FEATURE (1)..(466): FVII variant (precursor R212Q)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGQIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 39 - protein, 466 aa, Homo sapiens
  MISC_FEATURE (1)..(466): FVII variant (precursor G216D)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGDKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 40 - protein, 466 aa, Homo sapiens
  MISC_FEATURE (1)..(466): FVII variant (precursor C238Y)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLYGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 41 - protein, 466 aa, Homo sapiens
  MISC_FEATURE (1)..(466): FVII variant (precursor T241N)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGNLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 42 - protein, 466 aa, Homo sapiens
  MISC_FEATURE (1)..(466): FVII variant (precursor C254Y)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHYFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 43 - protein, 466 aa, Homo sapiens
  MISC_FEATURE (1)..(466): FVII variant (precursor A266T)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLITVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 44 - protein, 466 aa, Homo sapiens
  MISC_FEATURE (1)..(466): FVII variant (precursor R283W)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSWRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 45 - protein, 466 aa, Homo sapiens
  MISC_FEATURE (1)..(466): FVII variant (precursor V295D)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYDPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 46 - protein, 466 aa, Homo sapiens
  MISC_FEATURE (1)..(466): FVII variant (precursor D302H)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHHIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 47 - protein, 466 aa, Homo sapiens
  MISC_FEATURE (1)..(466): FVII variant (precursor D302N)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHNIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 48 - protein, 466 aa, Homo sapiens
  MISC_FEATURE (1)..(466): FVII variant (precursor A304T)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDITLLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 49 - protein, 466 aa, Homo sapiens
  MISC_FEATURE (1)..(466): FVII variant (precursor A304V)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIVLLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 50 - protein, 466 aa, Homo sapiens
  MISC_FEATURE (1)..(466): FVII variant (precursor R307C)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLCLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 51 - protein, 466 aa, Homo sapiens
  MISC_FEATURE (1)..(466): FVII variant (precursor R307H)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLHLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 52 - protein, 466 aa, Homo sapiens
  MISC_FEATURE (1)..(466): FVII variant (precursor V312M)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPMVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 53 - protein, 466 aa, Homo sapiens
  MISC_FEATURE (1)..(466): FVII variant (precursor E325K)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPKRTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 54 - protein, 466 aa, Homo sapiens
  MISC_FEATURE (1)..(466): FVII variant (precursor T332M)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERMLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 55 - protein, 466 aa, Homo sapiens
  MISC_FEATURE (1)..(466): FVII variant (precursor V341F)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLFSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 56 - protein, 466 aa, Homo sapiens
  MISC_FEATURE (1)..(466): FVII variant (precursor A352T)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGTTALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 57 - protein, 466 aa, Homo sapiens
  MISC_FEATURE (1)..(466): FVII variant (precursor A354V)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATVLELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 58 - protein, 466 aa, Homo sapiens
  MISC_FEATURE (1)..(466): FVII variant (precursor M358I)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELIVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 59 - protein, 466 aa, Homo sapiens
  MISC_FEATURE (1)..(466): FVII variant (precursor M358V)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELVVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 60 - protein, 466 aa, Homo sapiens
  MISC_FEATURE (1)..(466): FVII variant (precursor P363R)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVRRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 61 - protein, 466 aa, Homo sapiens
  MISC_FEATURE (1)..(466): FVII variant (precursor R364Q)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPQLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 62 - protein, 466 aa, Homo sapiens
  MISC_FEATURE (1)..(466): FVII variant (precursor T367S)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMSQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 63 - protein, 466 aa, Homo sapiens
  MISC_FEATURE (1)..(466): FVII variant (precursor C370F)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDFLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 64 - protein, 466 aa, Homo sapiens
  MISC_FEATURE (1)..(466): FVII variant (precursor C389G)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFGAGYSDGSKDSCKGDSGGPHATHYRGTWYLTGIVSWGQGCATVGHFGVYTRVSQYIEWLQKLMRSEPRPGVLLRAPFP

SEQ ID NO: 65 - protein, 466 aa, Homo sapiens
  MISC_FEATURE (1)..(466): FVII variant (precursor G391S)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCASYSDGSKDSCKGDSGGPHATHYRGTWYLTGIVSWGQGCATVGHFGVYTRVSQYIEWLQKLMRSEPRPGVLLRAPFP

SEQ ID NO: 66 - protein, 466 aa, Homo sapiens
  MISC_FEATURE (1)..(466): FVII variant (precursor G402E)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKEDSGGPHATHYRGTWYLTGIVSWGQGCATVGHFGVYTRVSQYIEWLQKLMRSEPRPGVLLRAPFP

SEQ ID NO: 67 - protein, 466 aa, Homo sapiens
  MISC_FEATURE (1)..(466): FVII variant (precursor G402R)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKRDSGGPHATHYRGTWYLTGIVSWGQGCATVGHFGVYTRVSQYIEWLQKLMRSEPRPGVLLRAPFP

SEQ ID NO: 68 - protein, 466 aa, Homo sapiens
  MISC_FEATURE (1)..(466): FVII variant (precursor D403H)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGHSGGPHATHYRGTWYLTGIVSWGQGCATVGHFGVYTRVSQYIEWLQKLMRSEPRPGVLLRAPFP

SEQ ID NO: 69 - protein, 466 aa, Homo sapiens [sequence omitted]

SEQ ID NO: 70 - protein, 466 aa, Homo sapiens
  MISC_FEATURE (1)..(466): FVII variant (precursor T419M)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLMGIVSWGQGCATVGHFGVYTRVSQYIEWLQKLMRSEPRPGVLLRAPFP

SEQ ID NO: 71 - protein, 466 aa, Homo sapiens
  MISC_FEATURE (1)..(466): FVII variant (precursor G435E)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFEVYTRVSQYIEWLQKLMRSEPRPGVLLRAPFP

SEQ ID NO: 72 - protein, 466 aa, Homo sapiens
  MISC_FEATURE (1)..(466): FVII variant (precursor E445K)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIKWLQKLMRSEPRPGVLLRAPFP

SEQ ID NO: 73 - protein, 466 aa, Homo sapiens
  MISC_FEATURE (1)..(466): FVII variant (precursor R375W)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSWKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 74 - protein, 466 aa, Homo sapiens
  MISC_FEATURE (1)..(466): FVII variant (precursor R375K)
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSKKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 75 - protein, 304 aa, Homo sapiens
  MISC_FEATURE (1)..(304): TFPI isoform a precursor
MIYTMKKVHALWASVCLLLNLAPAPLNADSEEDEEHTIITDTELPPLKLMHSFCAFKADDGPCKAIMKRFFFNIFTRQCEEFIYGGCEGNQNRFESLEECKKMCTRDNANRIIKTTLQQEKPDFCFLEEDPGICRGYITRYFYNNQTKQCERFKYGGCLGNMNNFETLEECKNICEDGPNGFQVDNYGTQLNAVNNSLTPQSTKVPSLFEFHGPSWCLTPADRGLCRANENRFYYNSVIGKCRPFKYSGCGGNENNFTSKQECLRACKKGFIQRISKGGLIKTKRKRKKQRVKIAYEEIFVKNM

SEQ ID NO: 76 - protein, 276 aa, Homo sapiens
  MISC_FEATURE (1)..(276): TFPI isoform a mature
DSEEDEEHTIITDTELPPLKLMHSFCAFKADDGPCKAIMKRFFFNIFTRQCEEFIYGGCEGNQNRFESLEECKKMCTRDNANRIIKTTLQQEKPDFCFLEEDPGICRGYITRYFYNNQTKQCERFKYGGCLGNMNNFETLEECKNICEDGPNGFQVDNYGTQLNAVNNSLTPQSTKVPSLFEFHGPSWCLTPADRGLCRANENRFYYNSVIGKCRPFKYSGCGGNENNFTSKQECLRACKKGFIQRISKGGLIKTKRKRKKQRVKIAYEEIFVKNM

SEQ ID NO: 77 - protein, 251 aa, Homo sapiens
  MISC_FEATURE (1)..(251): TFPI isoform b precursor
MIYTMKKVHALWASVCLLLNLAPAPLNADSEEDEEHTIITDTELPPLKLMHSFCAFKADDGPCKAIMKRFFFNIFTRQCEEFIYGGCEGNQNRFESLEECKKMCTRDNANRIIKTTLQQEKPDFCFLEEDPGICRGYITRYFYNNQTKQCERFKYGGCLGNMNNFETLEECKNICEDGPNGFQVDNYGTQLNAVNNSLTPQSTKVPSLFVTKEGTNDGWKNAAHIYQVFLNAFCIHASMFFLGLDSISCLC

SEQ ID NO: 78 - protein, 222 aa, Homo sapiens
  MISC_FEATURE (1)..(222): TFPI isoform b mature
SEEDEEHTIITDTELPPLKLMHSFCAFKADDGPCKAIMKRFFFNIFTRQCEEFIYGGCEGNQNRFESLEECKKMCTRDNANRIIKTTLQQEKPDFCFLEEDPGICRGYITRYFYNNQTKQCERFKYGGCLGNMNNFETLEECKNICEDGPNGFQVDNYGTQLNAVNNSLTPQSTKVPSLFVTKEGTNDGWKNAAHIYQVFLNAFCIHASMFFLGLDSISCLC

SEQ ID NO: 79 - protein, 213 aa, Homo sapiens
  MISC_FEATURE (1)..(213): TFPI-2 mature
DAAQEPTGNNAEICLLPLDYGPCRALLLRYYYDRYTQSCRQFLYGGCEGNANNFYTWEACDDACWRIEKVPKVCRLQVSVDDQCEGSTEKYFFNLSSMTCEKFFSGGCHRNRIENRFPDEATCMGFCAPKKIPSFCYSPKDEGLCSANVTRYYFNPRYRTCDAFTYTGCGGNDNNFVSREDCKRACAKALKKKKKMPKLRFASRIRKIRKKQF

SEQ ID NO: 80 - protein, 245 aa, Homo sapiens
  MISC_FEATURE (1)..(245): Chymotrypsinogen B mature
CGVPAIHPVLSGLSRIVNGEDAVPGSWPWQVSLQDKTGFHFCGGSLISEDWVVTAAHCGVRTSDVVVAGEFDQGSDEENIQVLKIAKVFKNPKFSILTVNNDITLLKLATPARFSQTVSAVCLPSADDDFPAGTLCATTGWGKTKYNANKTPDKLQQAALPLLSNAECKKSWGRRITDVMICAGASGVSSCMGDSGGPLVCQKDGAWTLVGIVSWGSDTCSTSSPGVYARVTKLIPWVQKILAAN

SEQ ID NO: 81 - DNA, 3141 bp, Homo sapiens
  misc_feature (1)..(3141): FVII transcript variant 1
agtcccatggggaatgtcaacaggcaggggcagcactgcagagatttcatcatggtctcccaggccctcaggctcctctgccttctgcttgggcttcagggctgcctggctgcaggcggggtcgctaaggcctcaggaggagaaacacgggacatgccgtggaagccggggcctcacagagtcttcgtaacccaggaggaagcccacggcgtcctgcaccggcgccggcgcgccaacgcgttcctggaggagctgcggccgggctccctggagagggagtgcaaggaggagcagtgctccttcgaggaggcccgggagatcttcaaggacgcggagaggacgaagctgttctggatttcttacagtgatggggaccagtgtgcctcaagtccatgccagaatgggggctcctgcaaggaccagctccagtcctatatctgcttctgcctccctgccttcgagggccggaactgtgagacgcacaaggatgaccagctgatctgtgtgaacgagaacggcggctgtgagcagtactgcagtgaccacacgggcaccaagcgctcctgtcggtgccacgaggggtactctctgctggcagacggggtgtcctgcacacccacagttgaatatccatgtggaaaaatacctattctagaaaaaagaaatgccagcaaaccccaaggccgaattgtggggggcaaggtgtgccccaaaggggagtgtccatggcaggtcctgttgttggtgaatggagctcagttgtgtggggggaccctgatcaacaccatctgggtggtctccgcggcccactgtttcgacaaaatcaagaactggaggaacctgatcgcggtgctgggcgagcacgacctcagcgagcacgacggggatgagcagagccggcgggtggcgcaggtcatcatccccagcacgtacgtcccgggcaccaccaaccacgacatcgcgctgctccgcctgcaccagcccgtggtcctcactgaccatgtggtgcccctctgcctgcccgaacggacgttctctgagaggacgctggccttcgtgcgcttctcattggtcagcggctggggccagctgctggaccgtggcgccacggccctggagctcatggtcctcaacgtgccccggctgatgacccaggactgcctgcagcagtcacggaaggtgggagactccccaaatatcacggagtacatgttctgtgccggctactcggatggcagcaaggactcctgcaagggggacagtggaggcccacatgccacccactaccggggcacgtggtacctgacgggcatcgtcagctggggccagggctgcgcaaccgtgggccactttggggtgtacaccagggtctcccagtacatcgagtggctgcaaaagctcatgcgctcagagccacgcccaggagtcctcctgcgagccccatttccctagcccagcagccctggcctgtggagagaaagccaaggctgcgtcgaactgtcctggcaccaaatcccatatattcttctgcagttaatggggtagaggagggcatgggagggagggagaggtggggagggagacagagacagaaacagagagagacagagacagagagagactgagggagagactctgaggacatggagagagactcaaagagactccaagattcaaagagactaatagagacacagagatggaatagaaaagatgagaggcagaggcagacaggcgctggacagaggggcaggggagtgccaaggttgtcctggaggcagacagcccagctgagcctccttacctcccttcagccaagcccacctgcacgtgatctgctggcctcaggctgctgctctgccttcattgctggagacagtagaggcatgaacacacatggatgcacacacacacacgccaatgcacacacacagagatatgcacacacacggatgcacacacagatggtcacacagagatacgcaaacacaccgatgcacacgcacatagagatatgcacacacagatgcacacacagatatacacatggatgcacgcacatgccaatgcacgcacacatcagtgcacacggatgcacagagatatgcacacaccgatgtgcgcacacacagatatgcacacacatggatgagcacacacacaccaatgcgcacacacaccgatgtacacacacagatgcacacacagatgcacacacaccgatgctgactccatgtgtgctgtcctctgaaggcggttgtttagctctcacttttctggttcttatccattatcatcttcacttcagacaattcagaagcatcaccatgcatggtggcgaatgcccccaaactctcccccaaatgtatttctcccttcgctgggtgccgggctgcacagactattccccacctgcttcccagcttcacaataaacggctgcgtctcctccgcacacctgtggtgcctgccacccactgggttgcccatgattcatttttggagcccccggtgctcatcctctgagatgctcttttctttcacaattttcaacatcactgaaatgaaccctcacatggaagctattttttaaaaacaaaagctgtttgatagatgtttgaggctgtagctcccaggatcctgtggaattggatgttctctccctgccacagcccttgtcaatgatatttcacagagaccctgggagcacctgctcaagagtcagggacacacgcatcactaaatgcaagttcccaggccctggctgcagtgggaggacctggcaagctgcactcttgctgagtccccagggtggtggaagaagaatgagaaacacatgaacagagaaatggggaggtgacaaacagtgcccccactcagactccggcaagcacggctcagagagtggactcgatgccatccctgcagggccgtcctgggcaccactggcactcacagcagcaaggtgggcaccattggcactcacagcagcaaggcaggcaccagcaacccacctcgggggcactcaggcatcatctacttcagagcagacagggtctatgaactacagccgtgggctgcttccaaggcaccctgctcttgtaaataaagttttatgggaacacaaaaaaaaaaaaaaaaa

SEQ ID NO: 82 - DNA, 3075 bp, Homo sapiens
  misc_feature (1)..(3075): FVII transcript variant 2
agtcccatggggaatgtcaacaggcaggggcagcactgcagagatttcatcatggtctcccaggccctcaggctcctctgccttctgcttgggcttcagggctgcctggctgcagtcttcgtaacccaggaggaagcccacggcgtcctgcaccggcgccggcgcgccaacgcgttcctggaggagctgcggccgggctccctggagagggagtgcaaggaggagcagtgctccttcgaggaggcccgggagatcttcaaggacgcggagaggacgaagctgttctggatttcttacagtgatggggaccagtgtgcctcaagtccatgccagaatgggggctcctgcaaggaccagctccagtcctatatctgcttctgcctccctgccttcgagggccggaactgtgagacgcacaaggatgaccagctgatctgtgtgaacgagaacggcggctgtgagcagtactgcagtgaccacacgggcaccaagcgctcctgtcggtgccacgaggggtactctctgctggcagacggggtgtcctgcacacccacagttgaatatccatgtggaaaaatacctattctagaaaaaagaaatgccagcaaaccccaaggccgaattgtggggggcaaggtgtgccccaaaggggagtgtccatggcaggtcctgttgttggtgaatggagctcagttgtgtggggggaccctgatcaacaccatctgggtggtctccgcggcccactgtttcgacaaaatcaagaactggaggaacctgatcgcggtgctgggcgagcacgacctcagcgagcacgacggggatgagcagagccggcgggtggcgcaggtcatcatccccagcacgtacgtcccgggcaccaccaaccacgacatcgcgctgctccgcctgcaccagcccgtggtcctcactgaccatgtggtgcccctctgcctgcccgaacggacgttctctgagaggacgctggccttcgtgcgcttctcattggtcagcggctggggccagctgctggaccgtggcgccacggccctggagctcatggtcctcaacgtgccccggctgatgacccaggactgcctgcagcagtcacggaaggtgggagactccccaaatatcacggagtacatgttctgtgccggctactcggatggcagcaaggactcctgcaagggggacagtggaggcccacatgccacccactaccggggcacgtggtacctgacgggcatcgtcagctggggccagggctgcgcaaccgtgggccactttggggtgtacaccagggtctcccagtacatcgagtggctgcaaaagctcatgcgctcagagccacgcccaggagtcctcctgcgagccccatttccctagcccagcagccctggcctgtggagagaaagccaaggctgcgtcgaactgtcctggcaccaaatcccatatattcttctgcagttaatggggtagaggagggcatgggagggagggagaggtggggagggagacagagacagaaacagagagagacagagacagagagagactgagggagagactctgaggacatggagagagactcaaagagactccaagattcaaagagactaatagagacacagagatggaatagaaaagatgagaggcagaggcagacaggcgctggacagaggggcaggggagtgccaaggttgtcctggaggcagacagcccagctgagcctccttacctcccttcagccaagcccacctgcacgtgatctgctggcctcaggctgctgctctgccttcattgctggagacagtagaggcatgaacacacatggatgcacacacacacacgccaatgcacacacacagagatatgcacacacacggatgcacacacagatggtcacacagagatacgcaaacacaccgatgcacacgcacatagagatatgcacacacagatgcacacacagatatacacatggatgcacgcacatgccaatgcacgcacacatcagtgcacacggatgcacagagatatgcacacaccgatgtgcgcacacacagatatgcacacacatggatgagcacacacacaccaatgcgcacacacaccgatgtacacacacagatgcacacacagatgcacacacaccgatgctgactccatgtgtgctgtcctctgaaggcggttgtttagctctcacttttctggttcttatccattatcatcttcacttcagacaattcagaagcatcaccatgcatggtggcgaatgcccccaaactctcccccaaatgtatttctcccttcgctgggtgccgggctgcacagactattccccacctgcttcccagcttcacaataaacggctgcgtctcctccgcacacctgtggtgcctgccacccactgggttgcccatgattcatttttggagcccccggtgctcatcctctgagatgctcttttctttcacaattttcaacatcactgaaatgaaccctcacatggaagctattttttaaaaacaaaagctgtttgatagatgtttgaggctgtagctcccaggatcctgtggaattggatgttctctccctgccacagcccttgtcaatgatatttcacagagaccctgggagcacctgctcaagagtcagggacacacgcatcactaaatgcaagttcccaggccctggctgcagtgggaggacctggcaagctgcactcttgctgagtccccagggtggtggaagaagaatgagaaacacatgaacagagaaatggggaggtgacaaacagtgcccccactcagactccggcaagcacggctcagagagtggactcgatgccatccctgcagggccgtcctgggcaccactggcactcacagcagcaaggtgggcaccattggcactcacagcagcaaggcaggcaccagcaacccacctcgggggcactcaggcatcatctacttcagagcagacagggtctatgaactacagccgtgggctgcttccaaggcaccctgctcttgtaaataaagttttatgggaacacaaaaaaaaaaaaaaaaa

SEQ ID NO: 83 - protein, 46 aa, Homo sapiens
  MISC_FEATURE (1)..(46): factor IX Gla domain
YNSGKLEEFVQGNLERECMEEKCSFEEAREVFENTERTTEFWKQYV

SEQ ID NO: 84 - protein, 45 aa, Homo sapiens
  MISC_FEATURE (1)..(45): factor X Gla domain
ANSFLEEMKKGHLERECMEETCSYEEAREVFEDSDKTNEFWNKYK

SEQ ID NO: 85 - protein, 46 aa, Homo sapiens
  MISC_FEATURE (1)..(46): prothrombin/thrombin Gla domain
ANTFLEEVRKGNLERECVEETCSYEEAFEALESSTATDVFWAKYTA

SEQ ID NO: 86 - protein, 46 aa, Homo sapiens
  MISC_FEATURE (1)..(46): protein C Gla domain
ANSFLEELRHSSLERECIEEICDFEEAKEIFQNVDDTLAFWSKHVD

SEQ ID NO: 87 - protein, 46 aa, Homo sapiens
  MISC_FEATURE (1)..(46): protein S Gla domain
ANSLLEETKQGNLERECIEELCNKEEAREVFENDPETDYFYPKYLV

SEQ ID NO: 88 - protein, 47 aa, Homo sapiens
  MISC_FEATURE (1)..(47): osteocalcin (bone Gla protein) Gla domain
YLYQWLGAPVPYPDPLEPRREVCELNPDCDELADHIGFQEAYRRFYG

SEQ ID NO: 89 - protein, 47 aa, Homo sapiens
  MISC_FEATURE (1)..(47): matrix Gla protein Gla domain
RAKVQERIRERSKPVHELNREACDDYRLCERYAMVYGYNAAYNRYFR

SEQ ID NO: 90 - protein, 42 aa, Homo sapiens
  MISC_FEATURE (1)..(42): growth-arrest-specific protein 6 Gla domain
FEEAKQGHLERECVEELCSREEAREVFENDPETDYFYPRYLD

SEQ ID NO: 91 - protein, 46 aa, Homo sapiens
  MISC_FEATURE (1)..(46): protein Z Gla domain
AGSYLLEELFEGNLEKECYEEICVYEEAREVFENEVVTDEFWRRYK

SEQ ID NO: 92 - protein, 45 aa, Homo sapiens
  MISC_FEATURE (1)..(45): factor VII Gla domain
ANAFLEELRPGSLERECKEEQCSFEEAREIFKDAERTKLFWISYS

SEQ ID NO: 93 - protein, 40 aa, Notechis scutatus scutatus
  MISC_FEATURE (1)..(40): Venom coagulation factor Xa-like protease - Gla domain
  UNSURE (38)..(39): Xaa could be any amino acid
SNSLFEEIRPGNIERECIEEKCSKEEAREVFEDNEKTXXF

SEQ ID NO: 94 - protein, 46 aa, Tropidechis carinatus
  MISC_FEATURE (1)..(46): Venom coagulation factor Xa-like protease - Gla domain
SNSLFEEIRPGNIERECIEEKCSKEEAREVFEDNEKTETFWNVYVD

SEQ ID NO: 95 - protein, 464 aa, Homo sapiens
  MISC_FEATURE (1)..(464): Antithrombin III precursor
MYSNVIGTVTSGKRKVYLLSLLLIGFWDCVTCHGSPVDICTAKPRDIPMNPMCIYRSPEKKATEDEGSEQKIPEATNRRVWELSKANSRFATTFYQHLADSKNDNDNIFLSPLSISTAFAMTKLGACNDTLQQLMEVFKFDTISEKTSDQIHFFFAKLNCRLYRKANKSSKLVSANRLFGDKSLTFNETYQDISELVYGAKLQPLDFKENAEQSRAAINKWVSNKTEGRITDVIPSEAINELTVLVLVNTIYFKGLWKSKFSPENTRKELFYKADGESCSASMMYQEGKFRYRRVAEGTQVLELPFKGDDITMVLILPKPEKSLAKVEKELTPEVLQEWLDELEEMMLVVHMPRFRIEDGFSLKEQLQDMGLVDLFSPEKSKLPGIVAEGRDDLYVSDAFHKAFLEVNEEGSEAAASTAVVIAGRSLNPNRVTFKANRPFLVFIREVPLNTIIFMGRVANPCVK

SEQ ID NO: 96 - protein, 432 aa, Homo sapiens [sequence omitted]

SEQ ID NO: 97 - protein, 263 aa, Homo sapiens
  MISC_FEATURE (1)..(263): Mature tissue factor
SGTTNTVAAYNLTWKSTNFKTILEWEPKPVNQVYTVQISTKSGDWKSKCFYTTDTECDLTDEIVKDVKQTYLARVFSYPAGNVESTGSAGEPLYENSPEFTPYLETNLGQPTIQSFEQVGTKVNVTVEDERTLVRRNNTFLSLRDVFGKDLIYTLYYWKSSSSGKKTAKTNTNEFLIDVDKGENYCFSVQAVIPSRTVNRKSTDSPVECMGQEKGEFREIFYIIGAVVFVVIILVIILAISLHKCRKAGVGQSWKENSPLNVS

SEQ ID NO: 98 - protein, 406 aa, Homo sapiens
  MISC_FEATURE (1)..(406): Factor VIIa variant V21D/E154V/M156Q
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKDCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALVLQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 99 - DNA, 4278 bp, Artificial Sequence
  pCMV Script vector
atgcattagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagcgattacgccaagctcgaaattaaccctcactaaagggaacaaaagctggagctccaccgcggtggcggccgctctagcccgggcggatcccccgggctgcaggaattcgatatcaagcttatcgataccgtcgacctcgagggggggcccggtaccaggtaagtgtacccaattcgccctatagtgagtcgtattacaattcactcgatcgcccttcccaacagttgcgcagcctgaatggcgaatggagatccaatttttaagtgtataatgtgttaaactactgattctaattgtttgtgtattttagattcacagtcccaaggctcatttcaggcccctcagtcctcacagtctgttcatgatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttaacgcgtaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttatttttctaaatacattcaaatatgtatccgctcatgagacaataaccctgataaatgcttcaataatattgaaaaaggaagaatcctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaagatcgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagaacatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagaacttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccctagggggaggctaactgaaacacggaaggagacaataccggaaggaacccgcgctatgacggcaataaaaagacagaataaaacgcacggtgttgggtcgtttgttcataaacgcggggttcggtcccagggctggcactctgtcgataccccaccgagaccccattggggccaatacgcccgcgtttcttccttttccccaccccaccccccaagttcgggtgaaggcccagggctcgcagccaacgtcggggcggcaggccctgccatagcctcaggttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcc

SEQ ID NO: 100 - DNA, 45 bp, Artificial Sequence
  CBO-125 Factor VII Forward PCR Primer
gcatcatgacgtgacggatccgccaccatggtctcccaggccctc

SEQ ID NO: 101 - DNA, 45 bp, Artificial Sequence
  CBO-126 Factor VII Reverse PCR Primer
gatcgtacgatacgtgaattcctagggaaatggggctcgcaggag

SEQ ID NO: 102 - DNA, 1398 bp, Homo sapiens
  misc_feature (1)..(1398): FVII cDNA (template for PCR)
atggtctcccaggccctcaggctcctctgccttctgcttgggcttcagggctgcctggctgcaggcggggtcgctaaggcctcaggaggagaaacacgggacatgccgtggaagccggggcctcacagagtcttcgtaacccaggaggaagcccacggcgtcctgcaccggcgccggcgcgccaacgcgttcctggaggagctgcggccgggctccctggagagggagtgcaaggaggagcagtgctccttcgaggaggcccgggagatcttcaaggacgcggagaggacgaagctgttctggatttcttacagtgatggggaccagtgtgcctcaagtccatgccagaatgggggctcctgcaaggaccagctccagtcctatatctgcttctgcctccctgccttcgagggccggaactgtgagacgcacaaggatgaccagctgatctgtgtgaacgagaacggcggctgtgagcagtactgcagtgaccacacgggcaccaagcgctcctgtcggtgccacgaggggtactctctgctggcagacggggtgtcctgcacacccacagttgaatatccatgtggaaaaatacctattctagaaaaaagaaatgccagcaaaccccaaggccgaattgtggggggcaaggtgtgccccaaaggggagtgtccatggcaggtcctgttgttggtgaatggagctcagttgtgtggggggaccctgatcaacaccatctgggtggtctccgcggcccactgtttcgacaaaatcaagaactggaggaacctgatcgcggtgctgggcgagcacgacctcagcgagcacgacggggatgagcagagccggcgggtggcgcaggtcatcatccccagcacgtacgtcccgggcaccaccaaccacgacatcgcgctgctccgcctgcaccagcccgtggtcctcactgaccatgtggtgcccctctgcctgcccgaacggacgttctctgagaggacgctggccttcgtgcgcttctcattggtcagcggctggggccagctgctggaccgtggcgccacggccctggagctcatggtcctcaacgtgccccggctgatgacccaggactgcctgcagcagtcacggaaggtgggagactccccaaatatcacggagtacatgttctgtgccggctactcggatggcagcaaggactcctgcaagggggacagtggaggcccacatgccacccactaccggggcacgtggtacctgacgggcatcgtcagctggggccagggctgcgcaaccgtgggccactttggggtgtacaccagggtctcccagtacatcgagtggctgcaaaagctcatgcgctcagagccacgcccaggagtcctcctgcgagccccatttccc

SEQ ID NO: 103 - protein, 20 aa, Artificial Sequence
  serum albumin binding sequence
QRLMEDICLPRWGCLWEDDF

SEQ ID NO: 104 - protein, 14 aa, Artificial Sequence
  serum albumin binding sequence
IEDICLPRWGCLWE

SEQ ID NO: 105 - protein, 13 aa, Artificial Sequence
  serum albumin binding sequence
DICLPRWGCLWED

SEQ ID NO: 106 - protein, 13 aa, Artificial Sequence
  serum albumin binding sequence
IEDICLPRWGCLW

SEQ ID NO: 107 - protein, 17 aa, Artificial Sequence
  serum albumin binding sequence
GGGSIEDICLPRWGCLW

SEQ ID NO: 108 - protein, 13 aa, Artificial Sequence
  serum albumin binding sequence
DICLPRWGCLWED

SEQ ID NO: 109 - protein, 17 aa, Artificial Sequence
  serum albumin binding sequence
GGGSDICLPRWGCLWED

SEQ ID NO: 110 - protein, 10 aa, Artificial Sequence
  platelet integrin IIb-IIIa binding sequence
SFGRGDIRNV

SEQ ID NO: 111 - protein, 12 aa, Artificial Sequence
  platelet integrin IIb-IIIa binding sequence
CSFGRGDIRNVC

SEQ ID NO: 112 - protein, 16 aa, Artificial Sequence
  platelet integrin IIb-IIIa binding sequence
GGGSCSFGRGDIRNVC

SEQ ID NO: 113 - protein, 406 aa, Homo sapiens
  MISC_FEATURE (1)..(406): Q286N
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGNLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 114 - protein, 406 aa, Homo sapiens
  MISC_FEATURE (1)..(406): Q286E
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGELLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 115 - protein, 406 aa, Homo sapiens
  MISC_FEATURE (1)..(406): Q286D
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGDLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 116 - protein, 406 aa, Homo sapiens
  MISC_FEATURE (1)..(406): Q286S
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGSLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 117 - protein, 406 aa, Homo sapiens
  MISC_FEATURE (1)..(406): Q286T
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGTLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 118 - protein, 406 aa, Homo sapiens
  MISC_FEATURE (1)..(406): Q286R
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 119 - protein, 406 aa, Homo sapiens
  MISC_FEATURE (1)..(406): Q286K
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGKLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 120 - protein, 406 aa, Homo sapiens
  MISC_FEATURE (1)..(406): Q286A
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGALLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 121 - protein, 406 aa, Homo sapiens
  MISC_FEATURE (1)..(406): Q286V
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGVLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 122 - protein, 406 aa, Homo sapiens
  MISC_FEATURE (1)..(406): Q286M
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGMLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 123 - protein, 406 aa, Homo sapiens
  MISC_FEATURE (1)..(406): Q296L
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGLLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 124 - protein, 406 aa, Homo sapiens
  MISC_FEATURE (1)..(406): Q286Y
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGYLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 125 - protein, 406 aa, Homo sapiens
  MISC_FEATURE (1)..(406): Q286G
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGGLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 126 - protein, 406 aa, Homo sapiens
  MISC_FEATURE (1)..(406): Q286F
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGFLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 127 - protein, 406 aa, Homo sapiens
  MISC_FEATURE (1)..(406): Q286I
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGILLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 128 - protein, 406 aa, Homo sapiens
  MISC_FEATURE (1)..(406): Q286P
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGPLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 129 - protein, 406 aa, Homo sapiens
  MISC_FEATURE (1)..(406): Q286H
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGHLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 130 - protein, 406 aa, Homo sapiens
  MISC_FEATURE (1)..(406): Q286W
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGWLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 131 - protein, 407 aa, Homo sapiens
  MISC_FEATURE (1)..(407): Q286R/Gla Swap FIX
YNSGKLEEFVQGNLERECMEEKCSFEEAREVFENTERTTEFWKQYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 132 - protein, 406 aa, Homo sapiens
  MISC_FEATURE (1)..(406): Q286R/H257A
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDAVVPLCLPERTFSERTLAFVRFSLVSGWGRLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 133 - protein, 406 aa, Homo sapiens
  MISC_FEATURE (1)..(406): Q286R/S222A
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQARRVAQVIIPSTYVPGTTNHDIALLRLHQPVVLTDHVVPLCLPERTFSERTLAFVRFSLVSGWGRLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 134 - protein, 406 aa, Homo sapiens
  MISC_FEATURE (1)..(406): Q286R/S222A/H257A
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQARRVAQVIIPSTYVPGTTNHDIALLRLHQPVVLTDAVVPLCLPERTFSERTLAFVRFSLVSGWGRLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 135 - protein, 407 aa, Homo sapiens
  MISC_FEATURE) (1)..(407): Q286R/S222A/Gla Swap FIX
YNSGKLEEFVQGNLERECMEEKCSFEEAREVFENTERTTEFWKQYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQARRVAQVIIPSTYVPGTTNHDIALLRLHQPVVLTDHVVPLCLPERTFSERTLAFVRFSLVSGWGRLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 136 - protein, 407 aa, Homo sapiens
  MISC_FEATURE (1)..(407): Q286R/H257A/Gla Swap FIX
YNSGKLEEFVQGNLERECMEEKCSFEEAREVFENTERTTEFWKQYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDAVVPLCLPERTFSERTLAFVRFSLVSGWGRLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 137 - protein, 407 aa, Homo sapiens
  MISC_FEATURE (1)..(407): Q286R/S222A/H257A/Gla Swap FIX
YNSGKLEEFVQGNLERECMEEKCSFEEAREVFENTERTTEFWKQYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQARRVAQVIIPSTYVPGTTNHDIALLRLHQPVVLTDAVVPLCLPERTFSERTLAFVRFSLVSGWGRLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 138 - protein, 406 aa, Homo sapiens
  MISC_FEATURE (1)..(406): Q286R/M298Q
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 139 - protein, 406 aa, Homo sapiens
  MISC_FEATURE (1)..(406): Q286R/M298Q/K341Q
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCQGDSGGPHATHYRGTWYLTGIVSWGQGCATVGHFGVYTRVSQYIEWLQKLMRSEPRPGVLLRAPFP

SEQ ID NO: 140 - protein, 406 aa, Homo sapiens
  MISC_FEATURE (1)..(406): Q286R/M298Q/K199E
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIENWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 141 - protein, 407 aa, Homo sapiens
  MISC_FEATURE (1)..(407): Q286R/M298Q/Gla Swap FIX
YNSGKLEEFVQGNLERECMEEKCSFEEAREVFENTERTTEFWKQYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 142 - protein, 406 aa, Homo sapiens
  MISC_FEATURE (1)..(406): Q286R/Q366V
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELMVLNVPRLMTQDCLQQSRKVGDSPNITEYMFCAGYSDGSKDSCKGDSGGPHATHYRGTWYLTGIVSWGVGCATVGHFGVYTRVSQYIEWLQKLMRSEPRPGVLLRAPFP

SEQ ID NO: 143 - protein, 406 aa, Homo sapiens
  MISC_FEATURE (1)..(406): Q286R/A292N/A294S/Q366V
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGNTSLELMVLNVPRLMTQDCLQQSRKVGDSPNITEYMFCAGYSDGSKDSCKGDSGGPHATHYRGTWYLTGIVSWGVGCATVGHFGVYTRVSQYIEWLQKLMRSEPRPGVLLRAPFP

SEQ ID NO: 144 - protein, 406 aa, Homo sapiens
  MISC_FEATURE (1)..(406): A175S/Q286R/Q366V
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGSQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELMVLNVPRLMTQDCLQQSRKVGDSPNITEYMFCAGYSDGSKDSCKGDSGGPHATHYRGTWYLTGIVSWGVGCATVGHFGVYTRVSQYIEWLQKLMRSEPRPGVLLRAPFP

SEQ ID NO: 145 - protein, 406 aa, Homo sapiens
  MISC_FEATURE (1)..(406): S222A/Q286R/Q366V
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQARRVAQVIIPSTYVPGTTNHDIALLRLHQPVVLTDHVVPLCLPERTFSERTLAFVRFSLVSGWGRLLDRGATALELMVLNVPRLMTQDCLQQSRKVGDSPNITEYMFCAGYSDGSKDSCKGDSGGPHATHYRGTWYLTGIVSWGVGCATVGHFGVYTRVSQYIEWLQKLMRSEPRPGVLLRAPFP

SEQ ID NO: 146 - protein, 406 aa, Homo sapiens
  MISC_FEATURE (1)..(406): H257S/Q286R
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDSVVPLCLPERTFSERTLAFVRFSLVSGWGRLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 147 - protein, 406 aa, Homo sapiens
  MISC_FEATURE (1)..(406): H257S/Q286R/Q366V
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDSVVPLCLPERTFSERTLAFVRFSLVSGWGRLLDRGATALELMVLNVPRLMTQDCLQQSRKVGDSPNITEYMFCAGYSDGSKDSCKGDSGGPHATHYRGTWYLTGIVSWGVGCATVGHFGVYTRVSQYIEWLQKLMRSEPRPGVLLRAPFP

SEQ ID NO: 148 - protein, 406 aa, Homo sapiens
  MISC_FEATURE (1)..(406): S222A/H257A/Q286R/Q366V
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQARRVAQVIIPSTYVPGTTNHDIALLRLHQPVVLTDAVVPLCLPERTFSERTLAFVRFSLVSGWGRLLDRGATALELMVLNVPRLMTQDCLQQSRKVGDSPNITEYMFCAGYSDGSKDSCKGDSGGPHATHYRGTWYLTGIVSWGVGCATVGHFGVYTRVSQYIEWLQKLMRSEPRPGVLLRAPFP

SEQ ID NO: 149 - protein, 406 aa, Homo sapiens
  MISC_FEATURE (1)..(406): Q286R/H373A
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELMVLNVPRLMTQDCLQQSRKVGDSPNITEYMFCAGYSDGSKDSCKGDSGGPHATHYRGTWYLTGIVSWGQGCATVGAFGVYTRVSQYIEWLQKLMRSEPRPGVLLRAPFP

SEQ ID NO: 150 - protein, 406 aa, Homo sapiens
  MISC_FEATURE (1)..(406): S222A/H257A/Q286R/M158Q
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQARRVAQVIIPSTYVPGTTNHDIALLRLHQPVVLTDAVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 151 - protein, 406 aa, Homo sapiens
  MISC_FEATURE (1)..(406): Q286R/K341D
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELMVLNVPRLMTQDCLQQSRKVGDSPNITEYMFCAGYSDGSKDSCDGDSGGPHATHYRGTWYLTGIVSWGQGCATVGHFGVYTRVSQYIEWLQKLMRSEPRPGVLLRAPFP

SEQ ID NO: 152 - protein, 406 aa, Homo sapiens
  MISC_FEATURE (1)..(406): Q286R/Q366D
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELMVLNVPRLMTQDCLQQSRKVGDSPNITEYMFCAGYSDGSKDSCKGDSGGPHATHYRGTWYLTGIVSWGDGCATVGHFGVYTRVSQYIEWLQKLMRSEPRPGVLLRAPFP

SEQ ID NO: 153 - protein, 406 aa, Homo sapiens
  MISC_FEATURE (1)..(406): Q286R/Q366N
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELMVLNVPRLMTQDCLQQSRKVGDSPNITEYMFCAGYSDGSKDSCKGDSGGPHATHYRGTWYLTGIVSWGNGCATVGHFGVYTRVSQYIEWLQKLMRSEPRPGVLLRAPFP

SEQ ID NO: 154 - protein, 406 aa, Homo sapiens
  MISC_FEATURE (1)..(406): Q286R/M298Q/Q366D
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGDGCATVGHFGVYTRVSQYIEWLQKLMRSEPRPGVLLRAPFP

SEQ ID NO: 155 - protein, 406 aa, Homo sapiens
  MISC_FEATURE (1)..(406): Q286R/M298Q/Q366N
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGNGCATVGHFGVYTRVSQYIEWLQKLMRSEPRPGVLLRAPFP

SEQ ID NO: 156 - protein, 406 aa, Homo sapiens
  MISC_FEATURE (1)..(406): Q286R/H373F
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELMVLNVPRLMTQDCLQQSRKVGDSPNITEYMFCAGYSDGSKDSCKGDSGGPHATHYRGTWYLTGIVSWGQGCATVGFFGVYTRVSQYIEWLQKLMRSEPRPGVLLRAPFP

SEQ ID NO: 157 - protein, 406 aa, Homo sapiens
  MISC_FEATURE (1)..(406): Q286R/M298Q/H373F
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGFFGVYTRVSQYIEWLQKLMRSEPRPGVLLRAPFP

SEQ ID NO: 158 - protein, 406 aa, Homo sapiens; identical to SEQ ID NO: 98
  MISC_FEATURE (1)..(406): V158D/E296V/M298Q

SEQ ID NO: 159 - protein, 406 aa, Homo sapiens
  MISC_FEATURE (1)..(406): T239S
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTSNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 160 - protein, 406 aa, Homo sapiens
  MISC_FEATURE (1)..(406): T239N
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTNNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 161 - protein, 406 aa, Homo sapiens
  MISC_FEATURE (1)..(406): T239Q
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTQNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 162 - protein, 406 aa, Homo sapiens
  MISC_FEATURE (1)..(406): T239V
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTVNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 163 - protein, 406 aa, Homo sapiens
  MISC_FEATURE (1)..(406): T239L
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTLNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 164 - protein, 406 aa, Homo sapiens
  MISC_FEATURE (1)..(406): T239H
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTHNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 165 - protein, 406 aa, Homo sapiens
  MISC_FEATURE (1)..(406): T239I
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTINHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 166 - protein, 406 aa, Homo sapiens
  MISC_FEATURE (1)..(406): P321K
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSKNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 167 - protein, 406 aa, Homo sapiens
  MISC_FEATURE (1)..(406): P321E
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSENITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 168 - protein, 406 aa, Homo sapiens
  MISC_FEATURE (1)..(406): P321Y
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSYNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 169 - protein, 406 aa, Homo sapiens
  MISC_FEATURE (1)..(406): P321S
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSSNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 170 - protein, 406 aa, Homo sapiens
  MISC_FEATURE (1)..(406): Q366D
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGDGCATVGHFGVYTRVSQYIEWLQKLMRSEPRPGVLLRAPFP

SEQ ID NO: 171 - protein, 406 aa, Homo sapiens
  MISC_FEATURE (1)..(406): Q366E
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGEGCATVGHFGVYTRVSQYIEWLQKLMRSEPRPGVLLRAPFP

SEQ ID NO: 172 - protein, 406 aa, Homo sapiens
  MISC_FEATURE (1)..(406): Q366N
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGNGCATVGHFGVYTRVSQYIEWLQKLMRSEPRPGVLLRAPFP

SEQ ID NO: 173 - protein, 406 aa, Homo sapiens
  MISC_FEATURE (1)..(406): Q366T
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGTGCATVGHFGVYTRVSQYIEWLQKLMRSEPRPGVLLRAPFP

SEQ ID NO: 174 - protein, 406 aa, Homo sapiens
  MISC_FEATURE (1)..(406): Q366S
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGSGCATVGHFGVYTRVSQYIEWLQKLMRSEPRPGVLLRAPFP

SEQ ID NO: 175 - protein, 406 aa, Homo sapiens
  MISC_FEATURE (1)..(406): Q366V
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGVGCATVGHFGVYTRVSQYIEWLQKLMRSEPRPGVLLRAPFP

SEQ ID NO: 176 - protein, 406 aa, Homo sapiens
  MISC_FEATURE (1)..(406): Q366I
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGIGCATVGHFGVYTRVSQYIEWLQKLMRSEPRPGVLLRAPFP

SEQ ID NO: 177 - protein, 406 aa, Homo sapiens
  MISC_FEATURE (1)..(406): Q366L
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGLGCATVGHFGVYTRVSQYIEWLQKLMRSEPRPGVLLRAPFP

SEQ ID NO: 178 - protein, 406 aa, Homo sapiens
  MISC_FEATURE (1)..(406): Q366M
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGMGCATVGHFGVYTRVSQYIEWLQKLMRSEPRPGVLLRAPFP

SEQ ID NO: 179 - protein, 406 aa, Homo sapiens
  MISC_FEATURE (1)..(406): H373D
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGDFGVYTRVSQYIEWLQKLMRSEPRPGVLLRAPFP

SEQ ID NO: 180 - protein, 406 aa, Homo sapiens
  MISC_FEATURE (1)..(406): H373E
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGEFGVYTRVSQYIEWLQKLMRSEPRPGVLLRAPFP

SEQ ID NO: 181 - protein, 406 aa, Homo sapiens
  MISC_FEATURE (1)..(406): H373S
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGSFGVYTRVSQYIEWLQKLMRSEPRPGVLLRAPFP

SEQ ID NO: 182 - protein, 406 aa, Homo sapiens
  MISC_FEATURE (1)..(406): H373F
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGFFGVYTRVSQYIEWLQKLMRSEPRPGVLLRAPFP

SEQ ID NO: 183 - protein, 406 aa, Homo sapiens
  MISC_FEATURE (1)..(406): H373A
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGAFGVYTRVSQYIEWLQKLMRSEPRPGVLLRAPFP

SEQ ID NO: 184 - protein, 406 aa, Homo sapiens
  MISC_FEATURE (1)..(406): Q366D/H373E
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGDGCATVGEFGVYTRVSQYIEWLQKLMRSEPRPGVLLRAPFP

SEQ ID NO: 185 - protein, 406 aa, Homo sapiens
  MISC_FEATURE (1)..(406): Q366V/H373V
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGVGCATVGVFGVYTRVSQYIEWLQKLMRSEPRPGVLLRAPFP

SEQ ID NO: 186 - protein, 406 aa, Homo sapiens
  MISC_FEATURE (1)..(406): Q366V/H373L
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGVGCATVGLFGVYTRVSQYIEWLQKLMRSEPRPGVLLRAPFP

SEQ ID NO: 187 - protein, 406 aa, Homo sapiens
  MISC_FEATURE (1)..(406): Q366V/H373I
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGVGCATVGIFGVYTRVSQYIEWLQKLMRSEPRPGVLLRAPFP

SEQ ID NO: 188 - protein, 406 aa, Homo sapiens
  MISC_FEATURE (1)..(406): K161S
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPSGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 189 - protein, 406 aa, Homo sapiens
  MISC_FEATURE (1)..(406): K161A
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPAGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 190 - protein, 406 aa, Homo sapiens
  MISC_FEATURE (1)..(406): K161V
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPVGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 191 - protein, 406 aa, Homo sapiens
  MISC_FEATURE (1)..(406): H216S
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSESDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 192 - protein, 406 aa, Homo sapiens
  MISC_FEATURE (1)..(406): H216A
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEADGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 193 - protein, 406 aa, Homo sapiens
  MISC_FEATURE (1)..(406): H216K
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEKDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 194 - protein, 406 aa, Homo sapiens
  MISC_FEATURE (1)..(406): H216R
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSERDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 195 - protein, 406 aa, Homo sapiens
  MISC_FEATURE (1)..(406): S222A
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQARRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 196 - protein, 406 aa, Homo sapiens
  MISC_FEATURE (1)..(406): S222K
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQKRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 197 - protein, 406 aa, Homo sapiens
  MISC_FEATURE (1)..(406): S222V
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQVRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 198 - protein, 406 aa, Homo sapiens
  MISC_FEATURE (1)..(406): S222N
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQNRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 199 - protein, 406 aa, Homo sapiens
  MISC_FEATURE (1)..(406): S222E
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQERRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 200 - protein, 406 aa, Homo sapiens
  MISC_FEATURE (1)..(406): S222D
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQDRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 201 - protein, 406 aa, Homo sapiens
  MISC_FEATURE (1)..(406): H257A
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDAVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 202 - protein, 406 aa, Homo sapiens
  MISC_FEATURE (1)..(406): H257S
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDSVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 203 - protein, 406 aa, Homo sapiens
  MISC_FEATURE (1)..(406): S222K/H257A
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQKRRVAQVIIPSTYVPGTTNHDIALLRLHQPVVLTDAVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 204 - protein, 406 aa, Homo sapiens
  MISC_FEATURE (1)..(406): H216A/H257A
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEADGDEQSRRVAQVIIPSTYVPGTTNHDIALLRLHQPVVLTDAVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 205 - protein, 406 aa, Homo sapiens
  MISC_FEATURE (1)..(406): H216A/S222A
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEADGDEQARRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 206 - protein, 406 aa, Homo sapiens
  MISC_FEATURE (1)..(406): S52A
ANAFLEELRPGSLERECKEEQCSFEEAREIFKDAERTKLFWISYSDGDQCAASPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 207 - protein, 406 aa, Homo sapiens
  MISC_FEATURE (1)..(406): S60A
ANAFLEELRPGSLERECKEEQCSFEEAREIFKDAERTKLFWISYSDGDQCASSPCQNGGACKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 208 - protein, 406 aa, Homo sapiens
  MISC_FEATURE (1)..(406): E394N/P395A/R396S
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSNASPGVLLRAPFP

SEQ ID NO: 209 - protein, 406 aa, Homo sapiens
  MISC_FEATURE (1)..(406): R202S
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWSNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 210 - protein, 406 aa, Homo sapiens
  MISC_FEATURE (1)..(406): A292N/A294S
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGNTSLELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 211 - protein, 406 aa, Homo sapiens
  MISC_FEATURE (1)..(406): G318N
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVNDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 212 - protein, 406 aa, Homo sapiens
  MISC_FEATURE (1)..(406): A175S
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGSQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 213 - protein, 406 aa, Homo sapiens
  MISC_FEATURE (1)..(406): K109N
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTNRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 214 - protein, 406 aa, Homo sapiens
  MISC_FEATURE (1)..(406): A122N/G124S
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLNDSVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 215 - protein, 406 aa, Homo sapiens
  MISC_FEATURE (1)..(406): A51N
ANAFLEELRPGSLERECKEEQCSFEEAREIFKDAERTKLFWISYSDGDQCNSSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 216 - protein, 406 aa, Homo sapiens
  MISC_FEATURE (1)..(406): T130N/E132S
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPNVSYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 217 - protein, 406 aa, Homo sapiens
  MISC_FEATURE (1)..(406): A122N/G124S/E394N/P395A/R396S
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLNDSVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSNAAPGVLLRAPFP

SEQ ID NO: 218 - protein, 406 aa, Homo sapiens
  MISC_FEATURE (1)..(406): A122N/G124S/E394N/P395A/R396S/G318N
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLNDSVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVNDSPNITEYMFCAGYSDGSKDSCKGDSGGPHATHYRGTWYLTGIVSWGQGCATVGHFGVYTRVSQYIEWLQKLMRSNAAPGVLLRAPFP

SEQ ID NO: 219 - protein, 406 aa, Homo sapiens
  MISC_FEATURE (1)..(406): S52A/S60A
ANAFLEELRPGSLERECKEEQCSFEEAREIFKDAERTKLFWISYSDGDQCAASPCQNGGACKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 220 - protein, 406 aa, Homo sapiens
  MISC_FEATURE (1)..(406): S52N/P54S
ANAFLEELRPGSLERECKEEQCSFEEAREIFKDAERTKLFWISYSDGDQCANSSCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 221 - protein, 406 aa, Homo sapiens
  MISC_FEATURE (1)..(406): S119N/L121S
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYNLSADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 222 - protein, 406 aa, Homo sapiens
  MISC_FEATURE (1)..(406): T128N/P129A
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCNATVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 223 - protein, 406 aa, Homo sapiens
  MISC_FEATURE (1)..(406): Q66N/Y68S
ANAFLEELRPGSLERECKEEQCSFEEAREIFKDAERTKLFWISYSDGDQCASSPCQNGGSCKDQLNSSICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 224 - protein, 406 aa, Homo sapiens
  MISC_FEATURE (1)..(406): S52N/P54S/A122N/G124S/E394N/P395A/R396S
ANAFLEELRPGSLERECKEEQCSFEEAREIFKDAERTKLFWISYSDGDQCANSSCQNGGSCKDQLQSYICFCLPAFEGRNCETHKDDQLICVNENGGCEQYCSDHTGTKRSCRCHEGYSLLNDSVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSNASPGVLLRAPFP

SEQ ID NO: 225 - protein, 406 aa, Homo sapiens
  MISC_FEATURE (1)..(406): K109N/A292N/A294S
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTNRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGNTSLELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 226 - protein, 406 aa, Homo sapiens
  MISC_FEATURE (1)..(406): K109N/A175S
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTNRSCRCHEGYSLLADGVSCTPTVEYPCGKIPILEKRNASKPQGRIVGGKVCPKGECPWQVLLLVNGSQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 227 - protein, 417 aa, Homo sapiens
  MISC_FEATURE (1)..(417): S103_S111delinsQRLMEDICLPRWGCLWEDDF
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCQRLMEDICLPRWGCLWEDDFCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 228 - protein, 414 aa, Homo sapiens
  MISC_FEATURE (1)..(414): H115_S126delinsQRLMEDICLPRWGCLWEDDF
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCQRLMEDICLPRWGCLWEDDFCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 229 - protein, 419 aa, Homo sapiens
  MISC_FEATURE (1)..(419): T128_P134delinsQRLMEDICLPRWGCLWEDDF
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCQRLMEDICLPRWGCLWEDDFCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 230 - protein, 411 aa, Homo sapiens
  MISC_FEATURE (1)..(411): S103_S111delinsIEDICLPRWGCLWE
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCIEDICLPRWGCLWECRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 231 - protein, 408 aa, Homo sapiens
  MISC_FEATURE (1)..(408): H115_S126delinsIEDICLPRWGCLWE
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCIEDICLPRWGCLWECTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 232 - protein, 413 aa, Homo sapiens
  MISC_FEATURE (1)..(413): T128_P134delinsIEDICLPRWGCLWE
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCIEDICLPRWGCLWECGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 233 - protein, 410 aa, Homo sapiens
  MISC_FEATURE (1)..(410): S103_S111delinsDICLPRWGCLWED
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCDICLPRWGCLWEDCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 234 - protein, 407 aa, Homo sapiens
  MISC_FEATURE (1)..(407): H115_S126delinsDICLPRWGCLWED
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCDICLPRWGCLWEDCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 235 - protein, 412 aa, Homo sapiens
  MISC_FEATURE (1)..(412): T128_P134delinsDICLPRWGCLWED
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCDICLPRWGCLWEDCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 236 - protein, 419 aa, Homo sapiens
  MISC_FEATURE (1)..(419): P406insIEDICLPRWGCLW
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFPIEDICLPRWGCLW

SEQ ID NO: 237 - protein, 423 aa, Homo sapiens
  MISC_FEATURE (1)..(423): P406insGGGSIEDICLPRWGCLW
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFPGGGSIEDICLPRWGCLW

SEQ ID NO: 238 - protein, 419 aa, Homo sapiens
  MISC_FEATURE (1)..(419): P406insDICLPRWGCLWED
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFPDICLPRWGCLWED

SEQ ID NO: 239 - protein, 423 aa, Homo sapiens
  MISC_FEATURE (1)..(423): P406insGGGSDICLPRWGCLWED
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFPGGGSDICLPRWGCLWED

SEQ ID NO: 240 - protein, 407 aa, Homo sapiens
  MISC_FEATURE (1)..(407): S103_S111delinsSFGRGDIRNV
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSFGRGDIRNVCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 241 - protein, 404 aa, Homo sapiens
  MISC_FEATURE (1)..(404): H115_S126delinsSFGRGDIRNV
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCSFGRGDIRNVCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 242 - protein, 409 aa, Homo sapiens
  MISC_FEATURE (1)..(409): T128_P134delinsSFGRGDIRNV
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCSFGRGDIRNVCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 243 - protein, 418 aa, Homo sapiens
  MISC_FEATURE (1)..(418): P406insCSFGRGDIRNVC
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFPCSFGRGDIRNVC

SEQ ID NO: 244 - protein, 422 aa, Homo sapiens
  MISC_FEATURE (1)..(422): P406insGGGSCSFGRGDIRNVC
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFPGGGSCSFGRGDIRNVC

SEQ ID NO: 245 - protein, 407 aa, Homo sapiens
  MISC_FEATURE (1)..(407): S222A/ Gla Swap FIX
YNSGKLEEFVQGNLERECMEEKCSFEEAREVFENTERTTEFWKQYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQARRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 246 - protein, 407 aa, Homo sapiens
  MISC_FEATURE (1)..(407): H257A/ Gla Swap FIX
YNSGKLEEFVQGNLERECMEEKCSFEEAREVFENTERTTEFWKQYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDAVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 247 - protein, 407 aa, Homo sapiens
  MISC_FEATURE (1)..(407): S222A/H257A/ Gla Swap FIX
YNSGKLEEFVQGNLERECMEEKCSFEEAREVFENTERTTEFWKQYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQARRVAQVIIPSTYVPGTTNHDIALLRLHQPVVLTDAVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 248 - protein, 406 aa, Homo sapiens
  MISC_FEATURE (1)..(406): S222A/M298Q
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQARRVAQVIIPSTYVPGTTNHDIALLRLHQPVVLTDHVVPLCLPERTFSERTLAFVRFSLVSGWGQLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 249 - protein, 406 aa, Homo sapiens
  MISC_FEATURE (1)..(406): H257A/M298Q
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDAVVPLCLPERTFSERTLAFVRFSLVSGWGQLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 250 - protein, 406 aa, Homo sapiens
  MISC_FEATURE (1)..(406): S222A/H257A/M298Q
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQARRVAQVIIPSTYVPGTTNHDIALLRLHQPVVLTDAVVPLCLPERTFSERTLAFVRFSLVSGWGQLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 251 - protein, 406 aa, Homo sapiens
  MISC_FEATURE (1)..(406): S222A/A292N/A294S/Q366V
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQARRVAQVIIPSTYVPGTTNHDIALLRLHQPVVLTDHVVPLCLPERTFSERTLAFVRFSLVSGWGQLLDRGNTSLELMVLNVPRLMTQDCLQQSRKVGDSPNITEYMFCAGYSDGSKDSCKGDSGGPHATHYRGTWYLTGIVSWGVGCATVGHFGVYTRVSQYIEWLQKLMRSEPRPGVLLRAPFP

SEQ ID NO: 252 - protein, 406 aa, Homo sapiens
  MISC_FEATURE (1)..(406): A175S/S222A/Q366V
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGSQLCGGTLINTIWVVSAAHCFDKIKNWRNLIAVLGEHDLSEHDGDEQARRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGVGCATVGHFGVYTRVSQYIEWLQKLMRSEPRPGVLLRAPFP

SEQ ID NO: 253 - protein, 406 aa, Homo sapiens
  MISC_FEATURE (1)..(406): S222A/Q366V
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQARRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGVGCATVGHFGVYTRVSQYIEWLQKLMRSEPRPGVLLRAPFP

SEQ ID NO: 254 - protein, 406 aa, Homo sapiens
  MISC_FEATURE (1)..(406): H257S/Q366V
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDSVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGVGCATVGHFGVYTRVSQYIEWLQKLMRSEPRPGVLLRAPFP

SEQ ID NO: 255 - protein, 406 aa, Homo sapiens
  MISC_FEATURE (1)..(406): S222A/H373A
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQARRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGAFGVYTRVSQYIEWLQKLMRSEPRPGVLLRAPFP

SEQ ID NO: 256 - protein, 406 aa, Homo sapiens
  MISC_FEATURE (1)..(406): V158T/L287T/M298K
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKTCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQTLDRGATALELKVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 257 - protein, 406 aa, Homo sapiens
  MISC_FEATURE (1)..(406): V21D/L287T/M298K
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKDCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQTLDRGATALELKVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 258 - protein, 411 aa, Homo sapiens
  MISC_FEATURE (1)..(411): S103_S111delinsIEDICLPRWGCLWE/G237V
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCIEDICLPRWGCLWECRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPVTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 259 - protein, 410 aa, Homo sapiens
  MISC_FEATURE (1)..(410): S103_S111delinsDICLPRWGCLWED/G237V
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCDICLPRWGCLWEDCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPVTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 260 - protein, 414 aa, Homo sapiens
  MISC_FEATURE (1)..(414): H115_S126delinsQRLMEDICLPRWGCLWEDDF/G237V
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCQRLMEDICLPRWGCLWEDDFCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPVTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 261 - protein, 408 aa, Homo sapiens
  MISC_FEATURE (1)..(408): H115_S126delinsIEDICLPRWGCLWE/G237V
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCIEDICLPRWGCLWECTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPVTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 262 - protein, 407 aa, Homo sapiens
  MISC_FEATURE (1)..(407): H115_S126delinsDICLPRWGCLWED/G237V
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCDICLPRWGCLWEDCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPVTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 263 - protein, 419 aa, Homo sapiens
  MISC_FEATURE (1)..(419): T128_P134delinsQRLMEDICLPRWGCLWEDDF/G237V
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCQRLMEDICLPRWGCLWEDDFCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPVTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 264 - protein, 413 aa, Homo sapiens
  MISC_FEATURE (1)..(413): T128_P134delinsIEDICLPRWGCLWE/G237V
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCIEDICLPRWGCLWECGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPVTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 265 - protein, 417 aa, Homo sapiens
  MISC_FEATURE (1)..(417): S103_S111delinsQRLMEDICLPRWGCLWEDDF/G237V
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCQRLMEDICLPRWGCLWEDDFCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPVTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 266 - protein, 412 aa, Homo sapiens
  MISC_FEATURE (1)..(412): T128_P134delinsDICLPRWGCLWED/G237V
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCDICLPRWGCLWEDCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPVTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 267 - protein, 407 aa, Homo sapiens
  MISC_FEATURE (1)..(407): S103_S111delinsSFGRGDIRNV/G237V
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSFGRGDIRNVCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPVTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 268 - protein, 404 aa, Homo sapiens
  MISC_FEATURE (1)..(404): H115_S126delinsSFGRGDIRNV/G237V
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCSFGRGDIRNVCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPVTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 269 - protein, 409 aa, Homo sapiens
  MISC_FEATURE (1)..(409): T128_P134delinsSFGRGDIRNV/G237V
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCSFGRGDIRNVCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPVTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 270 - protein, 406 aa, Homo sapiens
  MISC_FEATURE (1)..(406): M298Q/H373F
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELQVLNVPRLMTQDCLQQSRKVGDSPNITEYMFCAGYSDGSKDSCKGDSGGPHATHYRGTWYLTGIVSWGQGCATVGFFGVYTRVSQYIEWLQKLMRSEPRPGVLLRAPFP

SEQ ID NO: 271 - protein, 406 aa, Homo sapiens
  MISC_FEATURE (1)..(406): S119N/L121S/A175S
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYNLSADGVSCTPTVEYPCGKIPILEKRNASKPQGRIVGGKVCPKGECPWQVLLLVNGSQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 272 - protein, 406 aa, Homo sapiens
  MISC_FEATURE (1)..(406): T128N/P129A/A175S
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCNATVEYPCGKIPILEKRNASKPQGRIVGGKVCPKGECPWQVLLLVNGSQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 273 - protein, 406 aa, Homo sapiens
  MISC_FEATURE (1)..(406): A122N/G124S/A175S
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLNDSVSCTPTVEYPCGKIPILEKRNASKPQGRIVGGKVCPKGECPWQVLLLVNGSQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 274 - protein, 407 aa, Homo sapiens
  MISC_FEATURE (1)..(407): GlaSwapFIX/E39L/Q286R/M298Q
YNSGKLEEFVQGNLERECMEEKCSFEEAREVFENTERTTLFWKQYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 275 - protein, 407 aa, Homo sapiens
  MISC_FEATURE (1)..(407): GlaSwapFIX/K42I/Q286R/M298Q
YNSGKLEEFVQGNLERECMEEKCSFEEAREVFENTERTTEFWIQYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 276 - protein, 407 aa, Homo sapiens
  MISC_FEATURE (1)..(407): GlaSwapFIX/Q43S/Q286R/M298Q
YNSGKLEEFVQGNLERECMEEKCSFEEAREVFENTERTTEFWKSYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 277 - protein, 407 aa, Homo sapiens
  MISC_FEATURE (1)..(407): GlaSwapFIX/M18K/Q286R/M298Q
YNSGKLEEFVQGNLERECKEEKCSFEEAREVFENTERTTEFWKQYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 278 - protein, 407 aa, Homo sapiens
  MISC_FEATURE (1)..(407): GlaSwapFIX/M18K/E39L/K42I/Q43S/Q286R/M298Q
YNSGKLEEFVQGNLERECKEEKCSFEEAREVFENTERTTLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 279 - protein, 406 aa, Homo sapiens
  MISC_FEATURE (1)..(406): T128N/P129A/Q286R
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCNATVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 280 - protein, 406 aa, Homo sapiens
  MISC_FEATURE (1)..(406): T128N/P129A/Q286R/M298Q
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCNATVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 281 - protein, 406 aa, Homo sapiens
  MISC_FEATURE (1)..(406): T128N/P129A/Q286R/H373F
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCNATVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELMVLNVPRLMTQDCLQQSRKVGDSPNITEYMFCAGYSDGSKDSCKGDSGGPHATHYRGTWYLTGIVSWGQGCATVGFFGVYTRVSQYIEWLQKLMRSEPRPGVLLRAPFP

SEQ ID NO: 282 - protein, 406 aa, Homo sapiens
  MISC_FEATURE (1)..(406): V158D/Q286R/E296V/M298Q
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKDCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALVLQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 283 - protein, 406 aa, Homo sapiens
  MISC_FEATURE (1)..(406): T128N/P129A/V158D/E296V/M298Q
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCNATVEYPCGKIPILEKRNASKPQGRIVGGKDCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALVLQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 284 - protein, 406 aa, Homo sapiens
  MISC_FEATURE (1)..(406): T128N/P129A/S222A
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCNATVEYPCGKIPILEKRNASKPQGRIVGGKVCPKGECPWQVLLLVNGAQLCGGTLINTIWVVSAAHCFDKIKNWRNLIAVLGEHDLSEHDGDEQARRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 285 - protein, 407 aa, Homo sapiens
  MISC_FEATURE (1)..(407): GlaSwapFIX/T128N/P129A/S222A/Q286R
YNSGKLEEFVQGNLERECMEEKCSFEEAREVFENTERTTEFWKQYSDGDQCASSPCQNGGSCKDQLQSYICFCLPAFEGRNCETHKDDQLICVNENGGCEQYCSDHTGTKRSCRCHEGYSLLADGVSCNATVEYPCGKIPILEKRNASKPQGRIVGGKVCPKGECPWQVLLLVNGAQLCGGTLINTIWVVSAAHCFDKIKNWRNLIAVLGEHDLSEHDGDEQARRVAQVIIPSTYVPGTTNHDIALLRLHQPVVLTDHVVPLCLPERTFSERTLAFVRFSLVSGWGRLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 286 - protein, 407 aa, Homo sapiens
  MISC_FEATURE (1)..(407): GlaSwapFIX/T128N/P129A/Q286R/M298Q
YNSGKLEEFVQGNLERECMEEKCSFEEAREVFENTERTTEFWKQYSDGDQCASSPCQNGGSCKDQLQSYICFCLPAFEGRNCETHKDDQLICVNENGGCEQYCSDHTGTKRSCRCHEGYSLLADGVSCNATVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 287 - protein, 406 aa, Homo sapiens
  MISC_FEATURE (1)..(406): T128N/P129A/S222A/H257A/Q286R/M298Q
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCNATVEYPCGKIPILEKRNASKPQGRIVGGKVCPKGECPWQVLLLVNGAQLCGGTLINTIWVVSAAHCFDKIKNWRNLIAVLGEHDLSEHDGDEQARRVAQVIIPSTYVPGTTNHDIALLRLHQPVVLTDAVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 288 - protein, 406 aa, Homo sapiens
  MISC_FEATURE (1)..(406): T128N/P129A/Q286R/M298Q/H373F
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCNATVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGFFGVYTRVSQYIEWLQKLMRSEPRPGVLLRAPFP

SEQ ID NO: 289 - protein, 406 aa, Homo sapiens
  MISC_FEATURE (1)..(406): S52A/S60A/V158D/E296V/M298Q
ANAFLEELRPGSLERECKEEQCSFEEAREIFKDAERTKLFWISYSDGDQCAASPCQNGGACKDQLQSYICFCLPAFEGRNCETHKDDQLICVNENGGCEQYCSDHTGTKRSCRCHEGYSLLADGVSCTPTVEYPCGKIPILEKRNASKPQGRIVGGKDCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALVLMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 290 - protein, 406 aa, Homo sapiens
  MISC_FEATURE (1)..(406): S52A/S60A/Q286R
ANAFLEELRPGSLERECKEEQCSFEEAREIFKDAERTKLFWISYSDGDQCAASPCQNGGACKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 291 - protein, 406 aa, Homo sapiens
  MISC_FEATURE (1)..(406): S52A/S60A/S222A
ANAFLEELRPGSLERECKEEQCSFEEAREIFKDAERTKLFWISYSDGDQCAASPCQNGGACKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQARRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 292 - protein, 407 aa, Homo sapiens
  MISC_FEATURE (1)..(407): GlaSwapFIX/S52A/S60A/S222A/Q286R
YNSGKLEEFVQGNLERECMEEKCSFEEAREVFENTERTTEFWKQYSDGDQCAASPCQNGGACKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQARRVAQVIIPSTYVPGTTNHDIALLRLHQPVVLTDHVVPLCLPERTFSERTLAFVRFSLVSGWGRLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 293 - protein, 406 aa, Homo sapiens
  MISC_FEATURE (1)..(406): S52A/S60A/Q286R/M298Q
ANAFLEELRPGSLERECKEEQCSFEEAREIFKDAERTKLFWISYSDGDQCAASPCQNGGACKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 294 - protein, 407 aa, Homo sapiens
  MISC_FEATURE (1)..(407): GlaSwapFIX/S52A/S60A/Q286R/M298Q
YNSGKLEEFVQGNLERECMEEKCSFEEAREVFENTERTTEFWKQYSDGDQCAASPCQNGGACKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 295 - protein, 406 aa, Homo sapiens
  MISC_FEATURE (1)..(406): S52A/S60A/S222A/H257A/Q286R/M298Q
ANAFLEELRPGSLERECKEEQCSFEEAREIFKDAERTKLFWISYSDGDQCAASPCQNGGACKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQARRVAQVIIPSTYVPGTTNHDIALLRLHQPVVLTDAVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 296 - protein, 406 aa, Homo sapiens
  MISC_FEATURE (1)..(406): S52A/S60A/Q286R/H373F
ANAFLEELRPGSLERECKEEQCSFEEAREIFKDAERTKLFWISYSDGDQCAASPCQNGGACKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELMVLNVPRLMTQDCLQQSRKVGDSPNITEYMFCAGYSDGSKDSCKGDSGGPHATHYRGTWYLTGIVSWGQGCATVGFFGVYTRVSQYIEWLQKLMRSEPRPGVLLRAPFP

SEQ ID NO: 297 - protein, 406 aa, Homo sapiens
  MISC_FEATURE (1)..(406): S52A/S60A/Q286R/M298Q/H373F
ANAFLEELRPGSLERECKEEQCSFEEAREIFKDAERTKLFWISYSDGDQCAASPCQNGGACKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGFFGVYTRVSQYIEWLQKLMRSEPRPGVLLRAPFP

SEQ ID NO: 298 - protein, 406 aa, Homo sapiens
  MISC_FEATURE (1)..(406): V158D/T239V/E296V/M298Q
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKDCPKGECPWQVLLLVNGAQLCGGTLINTIWVVSAAHCFDKIKNWRNLIAVLGEHDLSEHDGDEQSRRVAQVIIPSTYVPGTVNHDIALLRLHQPVVLTDHVVPLCLPERTFSERTLAFVRFSLVSGWGQLLDRGATALVLQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 299 - protein, 406 aa, Homo sapiens
  MISC_FEATURE (1)..(406): T239V/Q286R
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTVVPGTTNHDIALLRLHQPVVLTDHVVPLCLPERTFSERTLAFVRFSLVSGWGRLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 300 - protein, 406 aa, Homo sapiens
  MISC_FEATURE (1)..(406): S222A/T239V
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQARRVAQVIIPSTYVPGTVNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 301 - protein, 407 aa, Homo sapiens
  MISC_FEATURE (1)..(407): GlaSwapFIX/S222A/T239V/Q286R
YNSGKLEEFVQGNLERECMEEKCSFEEAREVFENTERTTEFWKQYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQARRVAQVIIPSTYVPGTVNHDIALLRLHQPVVLTDHVVPLCLPERTFSERTLAFVRFSLVSGWGRLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 302 - protein, 406 aa, Homo sapiens
  MISC_FEATURE (1)..(406): T239V/Q286R/M298Q
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTVNHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 303 - protein, 406 aa, Homo sapiens
  MISC_FEATURE (1)..(406): S222A/T239V/H257A/Q286R/M298Q
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQARRVAQVIIPSTYVPGTVNHDIALLRLHQPVVLTDAVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 304 - protein, 407 aa, Homo sapiens
  MISC_FEATURE (1)..(407): GlaSwapFIX/T239V/Q286R/M298Q
YNSGKLEEFVQGNLERECMEEKCSFEEAREVFENTERTTEFWKQYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTVNHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 305 - protein, 406 aa, Homo sapiens
  MISC_FEATURE (1)..(406): T239V/Q286R/H373F
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTVNHDIALLRLHQPVVLTDHVVPLCLPERTFSERTLAFVRFSLVSGWGRLLDRGATALELMVLNVPRLMTQDCLQQSRKVGDSPNITEYMFCAGYSDGSKDSCKGDSGGPHATHYRGTWYLTGIVSWGQGCATVGFFGVYTRVSQYIEWLQKLMRSEPRPGVLLRAPFP

SEQ ID NO: 306 - protein, 406 aa, Homo sapiens
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTVNHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGFFGVYTRVSQYIEWLQKLMRSEPRPGVLLRAPFP

SEQ ID NO: 307 - protein, 406 aa, Homo sapiens
  MISC_FEATURE (1)..(406): V158D/T239I/E296V/M298Q
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKDCPKGECPWQVLLLVNGAQLCGGTLINTIWVVSAAHCFDKIKNWRNLIAVLGEHDLSEHDGDEQSRRVAQVIIPSTYVPGTINHDIALLRLHQPVVLTDHVVPLCLPERTFSERTLAFVRFSLVSGWGQLLDRGATALVLQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 308 - protein, 406 aa, Homo sapiens
  MISC_FEATURE (1)..(406): T239I/Q286R
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTINHDIALLRLHQPVVLTDHVVPLCLPERTFSERTLAFVRFSLVSGWGRLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 309 - protein, 406 aa, Homo sapiens
  MISC_FEATURE (1)..(406): S222A/T239I
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQARRVAQVIIPSTYVPGTINHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 310 - protein, 407 aa, Homo sapiens
  MISC_FEATURE (1)..(407): GlaSwapFIX/S222A/T239I/Q286R
YNSGKLEEFVQGNLERECMEEKCSFEEAREVFENTERTTEFWKQYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQARRVAQVIIPSTYVPGTINHDIALLRLHQPVVLTDHVVPLCLPERTFSERTLAFVRFSLVSGWGRLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 311 - protein, 406 aa, Homo sapiens
  MISC_FEATURE (1)..(406): T239I/Q286R/M298Q
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTINHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 312 - protein, 406 aa, Homo sapiens
  MISC_FEATURE (1)..(406): S222A/T239I/H257A/Q286R/M298Q
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQARRVAQVIIPSTYVPGTINHDIALLRLHQPVVLTDAVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 313 - protein, 407 aa, Homo sapiens
  MISC_FEATURE (1)..(407): GlaSwapFIX/T239I/Q286R/M298Q
YNSGKLEEFVQGNLERECMEEKCSFEEAREVFENTERTTEFWKQYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTINHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 314 - protein, 406 aa, Homo sapiens
  MISC_FEATURE (1)..(406): T239I/Q286R/H373F
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTINHDIALLRLHQPVVLTDHVVPLCLPERTFSERTLAFVRFSLVSGWGRLLDRGATALELMVLNVPRLMTQDCLQQSRKVGDSPNITEYMFCAGYSDGSKDSCKGDSGGPHATHYRGTWYLTGIVSWGQGCATVGFFGVYTRVSQYIEWLQKLMRSEPRPGVLLRAPFP

SEQ ID NO: 315 - protein, 406 aa, Homo sapiens
  MISC_FEATURE (1)..(406): T239I/Q286R/M298Q/H373F
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTINHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGFFGVYTRVSQYIEWLQKLMRSEPRPGVLLRAPFP

SEQ ID NO: 316 - protein, 407 aa, Homo sapiens
  MISC_FEATURE (1)..(407): GlaSwapFIX/S222A/Q286R/H373F
YNSGKLEEFVQGNLERECMEEKCSFEEAREVFENTERTTEFWKQYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQARRVAQVIIPSTYVPGTTNHDIALLRLHQPVVLTDHVVPLCLPERTFSERTLAFVRFSLVSGWGRLLDRGATALELMVLNVPRLMTQDCLQQSRKVGDSPNITEYMFCAGYSDGSKDSCKGDSGGPHATHYRGTWYLTGIVSWGQGCATVGFFGVYTRVSQYIEWLQKLMRSEPRPGVLLRAPFP

SEQ ID NO: 317 - protein, 407 aa, Homo sapiens
  MISC_FEATURE (1)..(407): GlaSwapFIX/S222A/Q286R/M298Q
YNSGKLEEFVQGNLERECMEEKCSFEEAREVFENTERTTEFWKQYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQARRVAQVIIPSTYVPGTTNHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 318 - protein, 407 aa, Homo sapiens
  MISC_FEATURE (1)..(407): GlaSwapFIX/S222A/Q286R/M298Q/H373F
YNSGKLEEFVQGNLERECMEEKCSFEEAREVFENTERTTEFWKQYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQARRVAQVIIPSTYVPGTTNHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGFFGVYTRVSQYIEWLQKLMRSEPRPGVLLRAPFP

SEQ ID NO: 319 - protein, 406 aa, Homo sapiens
  MISC_FEATURE (1)..(406): V158D/E296V/M298Q/H373F
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKDCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALVLQVLNVPRLMTQDCLQQSRKVGDSPNITEYMFCAGYSDGSKDSCKGDSGGPHATHYRGTWYLTGIVSWGQGCATVGFFGVYTRVSQYIEWLQKLMRSEPRPGVLLRAPFP

SEQ ID NO: 320 - protein, 406 aa, Homo sapiens
  MISC_FEATURE (1)..(406): V158D/Q286R/E296V/M298Q/H373F
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKDCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALVLQVLNVPRLMTQDCLQQSRKVGDSPNITEYMFCAGYSDGSKDSCKGDSGGPHATHYRGTWYLTGIVSWGQGCATVGFFGVYTRVSQYIEWLQKLMRSEPRPGVLLRAPFP

SEQ ID NO: 321 - protein, 406 aa, Homo sapiens
  MISC_FEATURE (1)..(406): H257A/Q286R/M298Q
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDAVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 322 - protein, 406 aa, Homo sapiens
  MISC_FEATURE (1)..(406): H257S/Q286R/M298Q
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDSVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 323 - protein, 407 aa, Homo sapiens
  MISC_FEATURE (1)..(407): GlaSwapFIX/S222A/H257S/Q286R
YNSGKLEEFVQGNLERECMEEKCSFEEAREVFENTERTTEFWKQYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQARRVAQVIIPSTYVPGTTNHDIALLRLHQPVVLTDSVVPLCLPERTFSERTLAFVRFSLVSGWGRLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 324 - protein, 406 aa, Homo sapiens
  MISC_FEATURE (1)..(406): S222A/H257S/Q286R/M298Q
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQARRVAQVIIPSTYVPGTTNHDIALLRLHQPVVLTDSVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 325 - protein, 406 aa, Homo sapiens
  MISC_FEATURE (1)..(406): H257S/Q286R/M298Q/H373F
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDSVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGFFGVYTRVSQYIEWLQKLMRSEPRPGVLLRAPFP

SEQ ID NO: 326 - protein, 406 aa, Homo sapiens
  MISC_FEATURE (1)..(406): S222A/Q286R/M298Q/H373F
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQARRVAQVIIPSTYVPGTTNHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGFFGVYTRVSQYIEWLQKLMRSEPRPGVLLRAPFP

SEQ ID NO: 327 - protein, 407 aa, Homo sapiens
  MISC_FEATURE (1)..(407): GlaSwapFIX/Q366V
YNSGKLEEFVQGNLERECMEEKCSFEEAREVFENTERTTEFWKQYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGVGCATVGHFGVYTRVSQYIEWLQKLMRSEPRPGVLLRAPFP

SEQ ID NO: 328 - protein, 406 aa, Homo sapiens
  MISC_FEATURE (1)..(406): S222A/Q286R/M298Q
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQARRVAQVIIPSTYVPGTTNHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 329 - protein, 406 aa, Homo sapiens
  MISC_FEATURE (1)..(406): T28N/P129A/A175S/Q366V
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCNATVEYPCGKIPILEKRNASKPQGRIVGGKVCPKGECPWQVLLLVNGSQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGVGCATVGHFGVYTRVSQYIEWLQKLMRSEPRPGVLLRAPFP

SEQ ID NO: 330 - protein, 406 aa, Homo sapiens
  MISC_FEATURE (1)..(406): A122N/G124S/A175S/Q366V
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLNDSVSCTPTVEYPCGKIPILEKRNASKPQGRIVGGKVCPKGECPWQVLLLVNGSQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGVGCATVGHFGVYTRVSQYIEWLQKLMRSEPRPGVLLRAPFP

SEQ ID NO: 331 - protein, 406 aa, Homo sapiens
  MISC_FEATURE (1)..(406): T128N/P129A/A175S/S222A
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCNATVEYPCGKIPILEKRNASKPQGRIVGGKVCPKGECPWQVLLLVNGSQLCGGTLINTIWVVSAAHCFDKIKNWRNLIAVLGEHDLSEHDGDEQARRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 332 - protein, 406 aa, Homo sapiens
  MISC_FEATURE (1)..(406): A122N/G124S/A175S/S222A
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLNDSVSCTPTVEYPCGKIPILEKRNASKPQGRIVGGKVCPKGECPWQVLLLVNGSQLCGGTLINTIWVVSAAHCFDKIKNWRNLIAVLGEHDLSEHDGDEQARRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 333 - protein, 406 aa, Homo sapiens
  MISC_FEATURE (1)..(406): T128N/P129A/A175S/Q286
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCNATVEYPCGKIPILEKRNASKPQGRIVGGKVCPKGECPWQVLLLVNGSQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 334 - protein, 406 aa, Homo sapiens
  MISC_FEATURE (1)..(406): A122N/G124S/A175S/Q286R
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLNDSVSCTPTVEYPCGKIPILEKRNASKPQGRIVGGKVCPKGECPWQVLLLVNGSQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 335 - protein, 407 aa, Homo sapiens
  MISC_FEATURE (1)..(407): GlaSwapFIX/T128N/P129A/A175S/S222A/Q286R
YNSGKLEEFVQGNLERECMEEKCSFEEAREVFENTERTTEFWKQYSDGDQCASSPCQNGGSCKDQLQSYICFCLPAFEGRNCETHKDDQLICVNENGGCEQYCSDHTGTKRSCRCHEGYSLLADGVSCNATVEYPCGKIPILEKRNASKPQGRIVGGKVCPKGECPWQVLLLVNGSQLCGGTLINTIWVVSAAHCFDKIKNWRNLIAVLGEHDLSEHDGDEQARRVAQVIIPSTYVPGTTNHDIALLRLHQPVVLTDHVVPLCLPERTFSERTLAFVRFSLVSGWGRLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 336 - protein, 407 aa, Homo sapiens
  MISC_FEATURE (1)..(407): GlaSwapFIX/A122N/G124S/A175S/S222A/Q286R
YNSGKLEEFVQGNLERECMEEKCSFEEAREVFENTERTTEFWKQYSDGDQCASSPCQNGGSCKDQLQSYICFCLPAFEGRNCETHKDDQLICVNENGGCEQYCSDHTGTKRSCRCHEGYSLLNDSVSCTPTVEYPCGKIPILEKRNASKPQGRIVGGKVCPKGECPWQVLLLVNGSQLCGGTLINTIWVVSAAHCFDKIKNWRNLIAVLGEHDLSEHDGDEQARRVAQVIIPSTYVPGTTNHDIALLRLHQPVVLTDHVVPLCLPERTFSERTLAFVRFSLVSGWGRLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 337 - protein, 406 aa, Homo sapiens; identical to SEQ ID NO: 272
  MISC_FEATURE (1)..(406): T128N/P129A/A175S/Q286R/M298Q

SEQ ID NO: 338 - protein, 406 aa, Homo sapiens
  MISC_FEATURE (1)..(406): A122N/G124S/A175S/Q286R/M298Q
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLNDSVSCTPTVEYPCGKIPILEKRNASKPQGRIVGGKVCPKGECPWQVLLLVNGSQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 339 - protein, 406 aa, Homo sapiens
  MISC_FEATURE (1)..(406): T128N/P129A/A175S/S222A/H257A/Q286R/M298Q
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCNATVEYPCGKIPILEKRNASKPQGRIVGGKVCPKGECPWQVLLLVNGSQLCGGTLINTIWVVSAAHCFDKIKNWRNLIAVLGEHDLSEHDGDEQARRVAQVIIPSTYVPGTTNHDIALLRLHQPVVLTDAVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 340 - protein, 406 aa, Homo sapiens
  MISC_FEATURE (1)..(406): A122N/G124S/A175S/S222A/H257A/Q286R/M298Q
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLNDSVSCTPTVEYPCGKIPILEKRNASKPQGRIVGGKVCPKGECPWQVLLLVNGSQLCGGTLINTIWVVSAAHCFDKIKNWRNLIAVLGEHDLSEHDGDEQARRVAQVIIPSTYVPGTTNHDIALLRLHQPVVLTDAVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 341 - protein, 406 aa, Homo sapiens
  MISC_FEATURE (1)..(406): T128N/P129A/A175S/Q286R/M298Q/H373F
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCNATVEYPCGKIPILEKRNASKPQGRIVGGKVCPKGECPWQVLLLVNGSQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGFFGVYTRVSQYIEWLQKLMRSEPRPGVLLRAPFP

SEQ ID NO: 342 - protein, 406 aa, Homo sapiens
  MISC_FEATURE (1)..(406): A122N/G124S/A175S/Q286R/M298Q/H373F
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLNDSVSCTPTVEYPCGKIPILEKRNASKPQGRIVGGKVCPKGECPWQVLLLVNGSQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGFFGVYTRVSQYIEWLQKLMRSEPRPGVLLRAPFP

SEQ ID NO: 343 - protein, 406 aa, Homo sapiens
  MISC_FEATURE (1)..(406): E296V/M298Q
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALVLQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 344 - protein, 406 aa, Homo sapiens
  MISC_FEATURE (1)..(406): V158E
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKECPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 345 - protein, 406 aa, Homo sapiens
  MISC_FEATURE (1)..(406): E296R/M298K
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALRLQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 346 - protein, 406 aa, Homo sapiens
  MISC_FEATURE (1)..(406): K337A
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSADSCKGDSGGPHATHYRGTWYLTGIVSWGQGCATVGHFGVYTRVSQYIEWLQKLMRSEPRPGVLLRAPFP

SEQ ID NO: 347 - protein, 406 aa, Homo sapiens
  MISC_FEATURE (1)..(406): V158D/E296V/M298Q/K337A
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKDCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALVLQVLNVPRLMTQDCLQQSRKVGDSPNITEYMFCAGYSDGSADSCKGDSGGPHATHYRGTWYLTGIVSWGQGCATVGHFGVYTRVSQYIEWLQKLMRSEPRPGVLLRAPFP

SEQ ID NO: 348 - protein, 406 aa, Homo sapiens
  MISC_FEATURE (1)..(406): V253N
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVNLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 349 - protein, 406 aa, Homo sapiens
  MISC_FEATURE (1)..(406): T106N
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHNGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 350 - protein, 406 aa, Homo sapiens
  MISC_FEATURE (1)..(406): T106N/V253N
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHNGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVNLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 351 - protein, 406 aa, Homo sapiens
  MISC_FEATURE (1)..(406): K143N/N145T
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILENRTASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 352 - protein, 406 aa, Homo sapiens
  MISC_FEATURE (1)..(406): R315N/V317T
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSNKTGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 353 - protein, 406 aa, Homo sapiens; identical to SEQ ID NO: 351
  MISC_FEATURE (1)..(406): K143N/N145T/R315N/V317T

SEQ ID NO: 354 - protein, 406 aa, Homo sapiens
  MISC_FEATURE (1)..(406): T128N/P129A/M298Q
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCNATVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 355 - protein, 407 aa, Homo sapiens
  MISC_FEATURE (1)..(407): (Gla Swap FIX /K43I)/T128N/P129A/Q286R/M298Q
YNSGKLEEFVQGNLERECMEEKCSFEEAREVFENTERTTEFWIQYSDGDQCASSPCQNGGSCKDQLQSYICFCLPAFEGRNCETHKDDQLICVNENGGCEQYCSDHTGTKRSCRCHEGYSLLADGVSCNATVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 356 - protein, 406 aa, Homo sapiens
  MISC_FEATURE (1)..(406): T128N/P129A/Q286R/M298Q/Q366N
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCNATVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGNGCATVGHFGVYTRVSQYIEWLQKLMRSEPRPGVLLRAPFP

SEQ ID NO: 357 - protein, 407 aa, Homo sapiens
  MISC_FEATURE (1)..(407): (Gla Swap FIX /K43I)/Q286R/M298Q/Q366N
YNSGKLEEFVQGNLERECMEEKCSFEEAREVFENTERTTEFWIQYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGNGCATVGHFGVYTRVSQYIEWLQKLMRSEPRPGVLLRAPFP

SEQ ID NO: 358 - protein, 407 aa, Homo sapiens
  MISC_FEATURE (1)..(407): (Gla Swap FIX /K43I)/T128N/P129A/Q286R/M298Q/Q366N
YNSGKLEEFVQGNLERECMEEKCSFEEAREVFENTERTTEFWIQYSDGDQCASSPCQNGGSCKDQLQSYICFCLPAFEGRNCETHKDDQLICVNENGGCEQYCSDHTGTKRSCRCHEGYSLLADGVSCNATVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGNGCATVGHFGVYTRVSQYIEWLQKLMRSEPRPGVLLRAPFP

SEQ ID NO: 359 - protein, 406 aa, Homo sapiens
  MISC_FEATURE (1)..(406): T128N/P129A/M298Q/H373F
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCNATVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELQVLNVPRLMTQDCLQQSRKVGDSPNITEYMFCAGYSDGSKDSCKGDSGGPHATHYRGTWYLTGIVSWGQGCATVGFFGVYTRVSQYIEWLQKLMRSEPRPGVLLRAPFP

SEQ ID NO: 360 - protein, 406 aa, Homo sapiens; identical to SEQ ID NO: 282
  MISC_FEATURE (1)..(406): V158D/Q286R/E296V/M298Q

SEQ ID NO: 361 - protein, 406 aa, Homo sapiens
  MISC_FEATURE (1)..(406): M298Q/Q366N/H373F
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELQVLNVPRLMTQDCLQQSRKVGDSPNITEYMFCAGYSDGSKDSCKGDSGGPHATHYRGTWYLTGIVSWGNGCATVGFFGVYTRVSQYIEWLQKLMRSEPRPGVLLRAPFP

SEQ ID NO: 362 - protein, 406 aa, Homo sapiens
  MISC_FEATURE (1)..(406): T239V/M298Q/H373F
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTVNHDIALLRLHQPVVLTDHVVPLCLPERTFSERTLAFVRFSLVSGWGQLLDRGATALELQVLNVPRLMTQDCLQQSRKVGDSPNITEYMFCAGYSDGSKDSCKGDSGGPHATHYRGTWYLTGIVSWGQGCATVGFFGVYTRVSQYIEWLQKLMRSEPRPGVLLRAPFP

SEQ ID NO: 363 - protein, 406 aa, Homo sapiens
  MISC_FEATURE (1)..(406): T239I/M298Q/H373F
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTINHDIALLRLHQPVVLTDHVVPLCLPERTFSERTLAFVRFSLVSGWGQLLDRGATALELQVLNVPRLMTQDCLQQSRKVGDSPNITEYMFCAGYSDGSKDSCKGDSGGPHATHYRGTWYLTGIVSWGQGCATVGFFGVYTRVSQYIEWLQKLMRSEPRPGVLLRAPFP

SEQ ID NO: 364 - protein, 406 aa, Homo sapiens
  MISC_FEATURE (1)..(406): T128N/P129A/Q286R/M298Q/Q366N/H373F
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCNATVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGNGCATVGFFGVYTRVSQYIEWLQKLMRSEPRPGVLLRAPFP

SEQ ID NO: 365 - protein, 406 aa, Homo sapiens
  MISC_FEATURE (1)..(406): T239V/Q286R/M298Q/Q366N
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTVNHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGNGCATVGHFGVYTRVSQYIEWLQKLMRSEPRPGVLLRAPFP

SEQ ID NO: 366 - protein, 406 aa, Homo sapiens
  MISC_FEATURE (1)..(406): T239I/Q286R/M298Q/Q366N
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTINHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGNGCATVGHFGVYTRVSQYIEWLQKLMRSEPRPGVLLRAPFP

SEQ ID NO: 367 - protein, 406 aa, Homo sapiens
  MISC_FEATURE (1)..(406): T128N/P129A/T239V/Q286R/M298Q
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCNATVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTVNHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 368 - protein, 406 aa, Homo sapiens
  MISC_FEATURE (1)..(406): T128N/P129A/S222A/T239V/H257A/Q286R/M298Q
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCNATVEYPCGKIPILEKRNASKPQGRIVGGKVCPKGECPWQVLLLVNGAQLCGGTLINTIWVVSAAHCFDKIKNWRNLIAVLGEHDLSEHDGDEQARRVAQVIIPSTYVPGTVNHDIALLRLHQPVVLTDAVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 369 - protein, 406 aa, Homo sapiens
  MISC_FEATURE (1)..(406): T128N/P129A/T239V/Q286R/M298Q/H373F
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCNATVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTVNHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGFFGVYTRVSQYIEWLQKLMRSEPRPGVLLRAPFP

SEQ ID NO: 370 - protein, 406 aa, Homo sapiens
  MISC_FEATURE (1)..(406): T128N/P129A/T239I/Q286R/M298Q
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCNATVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTINHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 371 - protein, 406 aa, Homo sapiens
  MISC_FEATURE (1)..(406): T128N/P129A/T239I/Q286R/M298Q/H373F
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCNATVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTINHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGFFGVYTRVSQYIEWLQKLMRSEPRPGVLLRAPFP

The invention claimed is:

1. A method of providing an on-demand treatment to a human subject experiencing a spontaneous bleed, comprising administering to the subject a subcutaneous dose of a modified FVIIa, wherein the modified FVIIa comprises the amino acid sequence set forth in SEQ ID NO: 280, wherein the subcutaneous dose is administered up to three times in a 24-hour period, and wherein each subcutaneous dose is about 20 µg/kg, 30 µg/kg, about 45 µg/kg, about 60 µg/kg, about 90 µg/kg or about 120 µg/kg of body weight of the subject.

2. The method of claim 1, wherein the spontaneous bleed is any one or more of a joint bleed, muscle bleed, and bleeding gums.

3. The method of claim 1, wherein the modified FVIIa is administered subcutaneously up to three times in a 24-hour period until the bleeding stops or the bleeding is corrected.

4. The method of claim 1, wherein the dose of the modified FVIIa is in a volume of less than about 5 mL.

5. The method of claim 1, further comprising administering any one or more of an additional coagulant treatment or factor, an anti-tissue factor pathway inhibitor (TFPI) antibody, an RNA interference (RNAi) therapeutic targeting antithrombin (AT), and emicizimab.

6. The method of claim 1, wherein the subject has any one or more of: blood coagulation disorders, hematologic disorders, hemorrhagic disorders, hemophilia A, hemophilia B, hemophilia A with inhibitors, hemophilia B with inhibitors, Factor VII deficiency, Glanzmann thrombasthenia, and acquired hemophilia, and/or wherein the subject is taking anti-coagulant therapy, and/or wherein the subject has autoantibodies to factor VIII or factor IX, and other bleeding disorders.

7. The method of claim 6, wherein the subject has hemophilia, and the hemophilia is congenital.

8. The method of claim 6, wherein the subject has hemophilia, and the hemophilia is acquired.

9. The method of claim 1, wherein the modified FVIIa polypeptide is a two-chain activated Factor VII (FVIIa) polypeptide comprising the amino acid sequence of SEQ ID NO: 280, and is cleaved between the arginine at position 152 and the isoleucine at position 153.

10. The method of claim 9, wherein the first and second chains of the two-chain polypeptide consist respectively of amino acids 1-152 and 153-406 of SEQ ID NO: 280.

11. The method of claim 1, wherein the modified FVIIa polypeptide is post-translationally modified, wherein a post-translational modification is any one or more of O-linked glycosylation, N-linked glycosylation, carboxylation of glutamic acid to γ-carboxyglutamic acid, and hydroxylation of aspartic acid to P-hydroxyaspartic acid.

12. The method of claim 1, wherein the modified FVIIa has any one or more of: increased coagulant activity in absence of tissue factor, increased coagulant activity in presence of tissue factor, increased kcat/km in a tissue-factor dependent assay, increased serum half-life, an increased terminal elimination half-life, greater coagulation activity, greater potency, and increased bioavailability as compared to an unmodified FVIIa comprising the amino acid sequence as set forth in SEQ ID NO: 3.

13. The method of claim 1, wherein the subcutaneous administration of the modified FVIIa exhibits an increased bioavailability compared to a subcutaneous administration of an unmodified FVIIa comprising the amino acid sequence as set forth in SEQ ID NO: 3.

14. The method of claim 1, wherein the subcutaneous administration of the modified FVIIa exhibits an increased terminal elimination half-life compared to an intravenous administration of the modified FVIIa.

15. The method of claim 1, wherein the subcutaneous administration of the modified FVIIa has an activity or potency greater than an intravenous administration of the modified FVIIa polypeptide has an activity or potency greater than an intravenous administration of an FVIIa polypeptide that is unmodified and/or has an activity or potency greater than a subcutaneous administration of an FVIIa polypeptide that is unmodified.

16. The method of claim 1, wherein the subcutaneous dose of a modified FVIIa is administered more than once and up to three times in a 24-hour period, and wherein each dose occurs about 2 to about 6 hours apart.

17. The method of claim 1, wherein the subject is experiencing a spontaneous bleed and the subcutaneous dose is administered about 1 minute to about 4 hours after onset of the bleed.

* * * * *